United States Patent 9,328,346 (POLYCOMB-ASSOCIATED NON-CODING RNAS) - sequence listing, part 61

SEQ ID NO: 12390 - RNA, 1652 nt, Mus musculus
ccccgcccgcccgcugcugcggaaggcgcagugcucaguaaagcgcacuuccucugcuggucuccaccgagggagugcccgcuccaagagcuccaagccgcaucgguccugcucugauccgaaggcgcagacaugucggaacaaaguaaggaccugagcgacccuaacuuugcagccgagguccccgacugugagaugcaggacagcgaugccguuccgguggggaucccuccucccgcuucucuggccgcuaaccucgcagggccaccgugcgcucccgaaggcccuauggcagcccaacaggccucgccaccgcccgaagaacggauagaagauguugacccuaaaauccugcagcaggccgcagaggagggccgcgcccaccagccccagaguccagcccggccgaucccagcaccgccagccccugcccagcuggugcagaaggcgcacgagcucaugugguacguguuggugaaggaccagaagaggaugguccucugguuuccagacauggugaaagaggucaugggcagcuacaagaaauggugcagaagcauccucaggcgcaccagcgucauccucgccagaguguucgggcugcaccugaggcugaccaaucuccacaccauggaguuugcccuggucaaagcccucagcccagaggagcuagacaggguggcgcucaacaaccguaugcccaugacaggccuccugcucaugauccugagccucaucuaugugaagggccgcggggccagagagggugcggucuggaaugugcugcgcauccuggggcugaggcccuggaagaagcacuccaccuucggagacgugaggaagauaaucaccgaggaguucguccagcagaauuaccugaaguaccagcgugugccccacaucgagccucccgaguacgaguucuucuggggguccagagcuaaccgugaaaucaccaagaugcagaucauggaguuccuggccagagucuucaagaaagauccccaggcguggccuucccgauacagggaggcucuggagcaggccagagcucugcgggaggcuaaucuugcugcccaggccccccgcagcagugucucugaggacuaaaaagguccaggggcacacugauaguuucugacccauacuagggcuguguaagggugggguugagucauuagaguaucccaaauccacagugcaguauuucauguauaauuuuuaaguuuuccauacagugcuuuuguaccuuguaaugcuauucauuuguguacucguguaguguuuaagauugaugcaugugugauaaguauuugguacuuucacuuuugugcuuucgugcauuuuuguacaagagaugugcugugcuaaacuugugaaauacauugagguguucuguaucuuguucuuuguaugggacugaugaucuguaucgacaaagaaggcccuggagaguuagcaggacuuaacagcaacgcagaccugagcaagagaaaggucaaggccuuucuccauaugacuucaacuggcacaggaagcauccauguggaauggacugauuugaacuggacuguucucaguguaggcacuuagcacccuuuacaaaacauguaugcaaccccaccauaaauaaacguuaaaaugagcauuaa

SEQ ID NO: 12391 - RNA, 281412 nt, Mus musculus
gcggccgccgcuuuguguguguccuggauuugggaaggagcucgcggcggcggcgcugagggaggaggcggcggcgagcggagcccagaggaggaggaggagccggaggagggggaaccgcucauucauuuccacuccgcauuucugccccucgccggccucgcccgcgcccgggacuucggaccagucucgccaacugcgucgcgcucucccgccgcguaggcuccgguggucguucccuccggggaucggguggcguuuguccucgccugcggcgauuugggcuuugcuccucuuucuguacaguuuuccuccuucuucugcaucucugcguuugcaaauggaggccgacgacgccgacagcccgccccggcgcgccccggcuucccgacuccgccgccccgugggccgcugcugccggcgcugaggggccgccccgcgccacccuccuuguccacgccgcuuuccgaggaucgucgccugcgcucuuguuuuuggacgagagugaggacugaguuggagacuuuuuuuuucuuuuuuucuuuucuuuuuuuuuuuuuuuucuauuuuugagaaaagggaauuucgucccaaauaaaaggaaugaagucuggcuccggaggaggguccccgaccucgcugugggggcucguguuucucuccgccgcgcucucucucuggccgacgaguggagaaagugaguauuugcccgccgcccgcggccacugcgggaacuuuuccuccgaggggcugcgcccuguuugggaaaacccaguugccacgggcgcagcugucggacuucggggcucgggaguggaggguggggcucucucggaaggccggaguagagcagggcccgagaguucacgacucaggagcuccuagagcccuagcucagcgcaucugcgcgcgggaagggccuuagggcuuucucuuucgcuguccggggagcgcugucccgcacgcggccuggugggugggcagugccuucucgcuggcgggucaggggcagcccccgcguaggcgcuugguggggaaguuggcgucuggguggccucgggaaccccgcuacucucgccccccccccuccggggcgcuccacuuggcaccccagcgcccaucccgcgcagcucaccaugacagcacccuuggaggcuccacgggugguugcugggguagaccuagugcuccguggcggcaauucggagccuccuacccugcgggguguaaguuguucuugagggggagauacaggaugguuggaagccucgcggccccaggacacguuuccaaacaucagggcgcagccuccuaucacccaacuuguugggcccaucgacccccucagguucuuggccuuucgcuucucuggagccugugggcgucuacccaccuaccccaaggcuugauaacuuggacaguccaguguggccuuggggugcagggugugcccaccauuuuccucuaggaaagugugaacuugggacuuucuucguggggggaggguuggaugauccucggcuuaggggcucucaguuucuauccagcucuggacacuuuuuucccagagcgucuuaguaagaggagauagguacguccacccuugugcagagucgacgugcuuuuccacacacacguguucagcgcggauuuaggugcauccacagccacacgaccgcgaggggagaaccggacucccagccugggggagagaugugugcgguggguugagcugcgacgggaucuguagugugguaguggacgggugguuguuuuguuuugcgagcgcggagcccuggccuugguuuuguuguggccaaaguuguggugcacugccaacaccucccccccccccccccccgcucugcacuuccuuuguacauacuuaauaagcaguaucgcucaugcuugcuaucgcuugcaaucugauagcuuuuguuuugguggugucggguaggaguagguggugguggggggugucucugggaaugagaacucuccacaguguaugcgggcaggaggaggaggaggggguuuuguucucgagaaaaacaguguggcauacuggugcuuuagagaugguagaguaauuugaacgcgauuaaaaguuuaaaugcagucuccgaguaggggcuggggaagugagggcgugcggaugaguaauguuugcagaauguaugcagguggugccuauuaacuucgaaaaaucacgaccuagccuugaguugggguggggggggggugugacacgauggagccugcuagggacccuaccgcugccguaguucacaaaggcuguuucuauaaacaaacccuugagccucuuuuaagaaauaucuaugauggaguccgaguaguucuuaaaagaacuauagcuauaguaagacuagagaaagacucgcagacuauggccgaccucacaaaucugggcucuccugcccuuuguuuuccaaacuuugagcacacuggauugggugaaaggcgguuagaugguguuugggggcagggaagauuucuagccuuuaaggacuaaauaugguuuagaagacacuaggaacgaguccauuuuccuauggcaucuuauuguacuguguacaucucuacuuuugcuauuuaacagcagaaguucugcaaugcaaagaagcagugguggccuugccuugcuucuuggggcaggaugcaggcauccgaaacaggacggagcugggucuugcugaaggauauucuuuguccagagcaggggcagcaggagaagggucuuucauuguguuguuuuuaauccgguggggaccaaacgcuuccugagagccgccuuuuaugauggucaauuuccuaaaguuugauggccauccugaaagcacuugggauccugguuagggccugcuaaaguucugucugggugucugcccuucccucuuuacagcugaaggguuaaguuuuagccccaaaggugcuaaaccacauaacugaggagaaagucucugggugccagcagaggcagucuuccagccauacagguauuagguuuaaggaauggugauucuuuggagugcgacaucuguggauauguuuucaucuuuaacuugggacuguggaaguuucuugaagaaaggcagcccugcagacauguuuguuuuguagcgggagaaugagcagaccuaggaaagggagcagccagauaauguagggccgcuuucuguuuugaaaaucaacaugcacuugagaguuauugugguugucuccuaaaaaggauugagucaucuuucugccgagggcacgguaaaauccuauugucagaggaaaggagguaugugcaauguugguguuuaaagaaguuagugcuuuauuaccuaccagaaggagagcccagaauaagaacuucagaaagaaccuaacuagcaaauuauaguuuagguuuugaugcagggaaauagcaagucaacuauacuuuguggagggccagacuggugcggguucagggcuugaaguuuaaaaggucauauguuugaauugucaaaaggauuagaaaagaccaucucugaaagauccaaggguugaacauccgggcgcuuaaaauauuaaaaacagagaaaauaaguuauaaacugccuaaucuuguaugaacacuacaugaacuuacaugaaauguucagccaauccauagggagagacaaauugcucaccagauauuggggaggacaaacugggaagugauuguuaagggguccaggauuuggggcaggugugugugugugugugugugugugugugugugugugcgcgugcgagugcgcgugugcgugugugugaugaaaguguuuuagcuucaguuuguggugaugguuguacaaauucucaauguacuaaaaaaaaaaauugaauuguaugguugaaaacagugaccugggggggggguaugugaguaacaucugaaccuguuuuguuuuuuuuuuuuaauuuuuuuucaaagauugagaagaaugcauugugcuaccuuaagccuuaaaaucugacuaagauuauucaguaaacauaggugcagguuugaguuggucucucccccccacccccaaauucaugagcuuuuaagauccaugaauuccugcaguacagcagauugguaauugaagcuguaacagcggggauuggaugccaggcaagaaacagacaaguagagggaaaggaaucuugcucuuccuuggcuugguaaauggagggauggauggagucaaccgggacagcacaccagugcuaaugaaggugugagcuccauagugaaagcccucaaacagaaccugaagugaacuucugcagggcucaggagccuaaggcaaggggcguguuucuaucuacagcuuuccaguagagaaguaguaugauguuagccacacggaaggaacuucuucccuccuguaguagccacaagugguccugaugcagaggaaggaccgcuuacuguagggcagugcgcgugcgacuuuccuuuucuuuuucuuuuucuuuuuucuuuaauuuacaaguuuuauuucuuaaaaucuccagaaucugagaaggugcaucuugguugguuacaguuguuguuuaggaaccuguagccuuaacaguuuuguuuuguuuuuaauaaaaauaaauaaauaaaauuaauuuuaggcacacagucaagugguuuuguuuucaaacuggcgugccuuuaucuaaauguacuuugccuuuuccguaggaacagaccuagacgggaauguuugcauuggguuuuuggucucugucuccaggucaucuguuggugaucucuuguuaugguugcaagguauagaucaguaaugaacaucagugagaucaucuucacuccuuguccgucugucucccuguucaucuguaugucugucuguccuuccuuccucccccccccccccccgggagcccugagagcacuuuaguuuuccuuuuaaugugguuucauuugguuugucagaaugcacuucaagugacugagucuagccagcaguuagugggcccuuacugugugaaagcugaagugaaugcuagguggcgcgaucaccaggagaggaaggacggacuccccuugcuguugccuuugguuccacucucccuguauuugcaggagaggcccuuuacaaaaacuaacaaucuacuguaggcuuagcuggucugguguguagccagugcuacacuguucuuacccucucaggcucccucauauuggaauuucaccacagaccauggcccacggauaccuguccaucuaguugggcgucuuuguaacacuggugugacagucgugguuaacgcugccuguguaacgucaugcuggaugcacucauagaccuguaagccuaggcagggggaaacgccaguuugagggcagccugugcuaaguagugacaccuugucuccaaaaucaacccccccccccccagggauauucauaaguguugccuggcuuggaaggugggaccaguugcagagguguuucccauguauacauugcuuucacaguuuggagauaaucauuaggaaguguucagaauuccaaaucuuuuguaauuuaaaaacgaauggacuuuuuuuuuuuuaaguaugggggaggggguguaagaacgagacagagaggcaauuguaccuuuaaaagaauuuuuuuuuuuuuuuuugaaucauaaagcacacaagacagguuuuucucugguuugugauuuucuccgauuuguuuucaagacucauuuaaaacucaaacucuaguucguggaagagguauuugugcccggaggccagcuugcuuugaacugcuuuucuuagccagcgugugacaggugcuaucugagcaccagaaaugaacgccuuucaguaguacuaaguauguaauacuuccacacgugcuguggccacggcggcucuuggcuucuccgucugagacgcccgaugcacgugaaagacagcaaacaggcuguacggugugaugaugcacucggagcuuccuguaaguaguguuuggcagcaggucugcaagaggaaguuuccaaguuccuuauaaagacguguuauuugggacgggcgcaguccuaguguucggugacgcugagaucuguggacauuggggagugcguggcugauguccaggauugguaaagauuaaagauuagaauguguacaggugccuugucucgauccccucacccccugggucugacuuguucagagaagaggacaugggcuugugaaaacaguaaacaaaggaucuuuaaaacgaguuaguucgcuaucucagcagauguaguuccuuagcaugaugaaguccguuucuuuucuuaaauuguuuggaauccuuuaacugaaaguacuagccuccuugauuuggugacuuuggauuucuggagauggaugccauguguucucacgcgugccaguuuuccuuacucuuuauuacugugaugggguuuagagcccuaagguugcuaugucccuacuugagugagaauucauccacuuucuuccauaaauacccuggguacucacaaggcuccauucucuggguuagaaacgcugauaccauaaugagucuuaccaccaguuuuucagaguaugaauugagccacagaaaucacggcuauguuugcauaaagaacuaagaagcuagugagcaaggcuuuaauuuuucuuucuuuugggucgcaaauuguaaggauuuauaaacucacagauugcuauucaggcauuacucgaacagaacaaaaacuggcguccuuuauguugagugaugaacagugggacuguggugacuuccacagauaacgacgcugcuguuugguuuuauauuuauccucaaguugguuacugcugguaugggaugcgucuugaggcuuagggaguaucccuccuguauuuucugguaggcuugacacaauuucucauggaguaucugguggccugcuaaagaagaagaauguggccauguuggaaguguguauugcagagagaagaaugucugucccaaauuguuuacuuugcaguggaaugucagaaacaacuuuggagagaccccgagguugcuuucuugauuuuuguuuuuuuccuagagauggucuugugguguagcccacacuggccuuggacuugaucuacccuugccucagaguacagggaucacccauaggccuguaccaccgaaguuggcuaggcaccucuugaagcguuuguagaaaggaguuuaucauuauuacagaaaauuccuccugguaguaggagcugaaggcuucaaacucuaucuuuuuacuucacaccucccugcaggaguuacauaaaugccagcuccucacaguggcacaugugcauccagaugggcauguuuguccaggugugcaugcgugcacuccuccacccacagagacugagugaccgacugaggugcauagcuccugggcuucuguguacuuaaacuugccaguuucuuuuuaaacacggcacuuccuuuaagcuggcuuuggaguugucguuuuuaagauuaaucuuuauguggguaacacauguuuuaugguauugaagccuaaauuguuuuacagaucagaacuugaaaguuccugagguauuuugcuuaucuauaaguugauuauugggggagugugucagaucgaguaaaugagacacguaccguaaggcacagaagccugaugauauuagauagcagugaguuaguguacagguauuuuucucccaauuugaauuauuuuaguaaccuuugauaaguagcugaaagaaauaaguagcaccugugcagauuucagguaacagccgucuguccgguugacuggacauuugacaagaccauucugagucacuagccguccacucuguuuagacagucagugaauucuucaccaguucaucaugccuagcugugucuuacgguguucauucucuccgacaguucucccugggcaucacuguacugagggaacgcacagggacgccccgccgaugguucugguguccacuuuggggcguuacuggcuucgugaugucuguugagccacaauguagaagagcuggauccuagagacuuccguugcuaagagcggccuuucuugguuggaugcuguauucuccccauuucuucuagcacgcucaccagugagcuuuucagucaccaagauuggcugcgauggaaggucuaguuaaccucagcucugcuuccugcccuuuucugaagagagugcuuaauugaauguuuccucucaacuucacugagucacuugaaaucaugcagauuugccccauccuggcuccacccccauccaguccagaccugcaucccaacccuuugaguagacagggcauacuuacuggccuuugagauacuucuaagugccauaaagaucccugggcuugcuuaccaagccugcuuccucgcuguguaccgcaggcgaguccccagucuuaaugugaaguccaaggccccucguauugggcuguaguagauccucauaaagaccucgcugucaggauccacauugauccccagaguucugcaugagugggcucugaugaucccccacuccagcuuuugcccucuuucugugacuuggcaugaauuccaccacagucuucugccccccuccccgcaauggacauuggaaagccccucuggaacaauggaaggucacgugggccuagauuccucugggccguccaucaguucucugauauaaaacaugccacuucucugaguuugagcaaauaggcggagacucgggaugacugugaaagacgguucuccuugucucuguaaacggcaaaauaaaauuaucuucuacuauauuuagaaaaauuaaacucaggaaaauuuggcggaaauguggauuuuuaaguuucauuacuuuuugagugugugugggggguguccaguuuuggauguugguacuguaaaguugggccgauaggguaggcuuccggucaacuccucccaggcccccccagcacuuucuaggguuuuaauaugugagagaugccgcccuugauguccuacccgccgccuucuccuucacaugaggcuguuagcguuucucuaacugcacagcucuaacuuuccccucccucccuuugaguucaggcaccaccaggccgcacacugagaagucucccucgggcuuuguccuuucccugucaugacuuaccgggaugaggaguggcgagggaggcugguuugaaugccaguucuucaguagcacagucagauuaauuuugugccuuuguuuccuccucugugaaauggggugaagggcgauugccaucaagccuaagagaccaguguuuaaucccugggacucauggugggagggagaaccaacucuccaagguagacuccccccccccccacggguacucuguggcaugccuccccacccccaacaaauaaauacgggaaaucaaagguacaggccuguaaucccagcauguggaaggcagaggcagagacaggugaaucucauugaguuuaagaccagccuagucuacauauguagugaguucugggccagccagugcuacauagugagaccuugucucaaaaacaaaaacaaaaaaccaccaaaacaaaaacaaaaacguuaacccuuucugaguuccguuauuuuauccccucccgccauccccccccccccaaaggguagccagcuccacucuguucaccuuccauuuuacaguuguuugucauaguuucuuccucaauccuuucucucguuaguuucugccagggucuuagaacggguccuaucugcacuuuguccgccucaccgaugcgaagucgccaucuagcggccacauagggaguucagccaucucccuggcugaaguagguguuguccagaggaggaagaaagccaauccccuuaaaguuccucagccuuucccugcugauggugacugagaaaugguugcaagaaaauguggguacaccaggcuucuuuagagaucgccgggcugugguuuaggauacagcuuguuuaacuguucagagagcggcucagagaagcaacuguauuccgaagugagguacccuuccuguaaaacccagagggucuuacaguccuaagaguacccuacccccaggccaugagaccuuuacgugugugcaguuuuaaaauauuucuuaugagagauuaauaaacaauacugcuaggaccaacaagauggcucggccagugaaggagcuugcugccaagucugccucugaguucaguuccugggacucagcacaguaggagaauagaacugacuccugcacguuguccuguggccuccauaugugugucgugacacuugcacgaccccucccagauaaacguaauuaaaacguuuugagaaggcugccaauuaauuucgaauggcauauucauagagcaaggucugucuuugaccucucugcuuaaacauagagugacacuucaaauuucgcucugaagugcguccccuugggcugcuucauguaguuaaaaugucuacccaacaguccugaugacagaccaucacaggcagcuccauuacucccuguguuggaggcacugugucagacuuuuuugguuuuguccucagaacuuauugauaauuucucaaucuacucucccauuuccccagugacacuguaucuaguggucacguucuucccugguggcucuuuguuuuuuaauuuuaacugggagauagcucauuugcugggcugagagaggacuucaguguguuuucugcccagacauuucaggcagcuccaccugcuguuucucaggcaggcccugacugaagccagauguugaacacacuagauuuucacugcccuagauugguucagagcacagcauauauacuaaguguucaauaaaugugcguucuguaauacaagguuugcuucgcuaagaugugaaagaauaauuaaauaauuuacaaguuugccccccuuaaggccagacaacaguugauuguacguuucugacuuuuuacacgugaugcacugaaccuguucuuccccaucauaggggaggggacaguuucucuacuaccuuugaacaccaggaaguagccagauguuugguggguaagagaugcucaggaaauggcagacuucuuaaagggaccaccuguaggucauucacuuggaugcauguaccguucauugacagcgaaggucuuauaucguccuugccauaguagcuuagcccuuggagacuuuuuuuuuuaaagauuuauuuauuuauuuauuauauguaaguacacuguagcuguccucagacacuccagaagagggugucagaucucguuacggaugguugugagccaccaugugguugcugggauuugaacuucggaccuucggaagagcagucgggugcucuuacccacugagccaucucaccagcccccuuggagacauuuuuaucacaccaguuacuacauagcacuuagaagcaguagaaugauguucaggucuuuuguuccaagaacugggcaaaaaacaaagcaaaauacccaacacuuuagaaaagccaucugcagaucuagucuuguaucccugaggugggugaccacgccccuuaagcuucauucugaugagaagacaagacugauuugccauuaucaguuccuuuguguguaguguacgcugaaccauugggcagccagcugccucauaaaagguugcugucuucagguuggcaguggcugccugucccucugcgguggauccugaggauuguguuccuucuccuucaggaaugacccugggucccuggaagaguuguuaugcuuguucagccuuuggauuccaaaaccaggcagugagggugguuuccuugggagggucguuuggaugagaccagcaaaaaaguugccucgcaucccggcaggcgcaguagccaggucuuagaugcuuguccuuugaguuccugacacggacugucaagaguuuaugauagggguaucgguaaaccucaccucuacagaauugaguuuacuuagccuaggaugcuguaaggggacugcugaacuuaaaacccacaggucauugcuaaaagcuugaugcuccugagguggucuguuuccuguagaaaaaugucaacagaaucauugaacgcaguauguuuuauuucaaguguggccuauagaaaaagcauuuuugaaaacucacccgccucacggcugagcugaguggacgugagcucaccugccuacccugccuuuagggaagccggcucuccccagguacuugguggcaugcuagagcgggaagcacggaccuugguugguacccaccuguaaauugaaaaagugccacucuagcaggcaugccaaagggaauuagcaguaauguuuuuaagaugcccgccagaaacaggcaguagaaggcaucuagcaaacgaauguguggauuuuuguccucccacguggcugugaggcccccggggauuccugucuuuuaguccuccuagcagccccugggaaaaugguggaggagggaaacauuguuauaucaguuauuuuggcuuaaaccugagaagccgagguuggagagauggcuuagcaguuaagagcacuggaauuagaacccagguucacuucucagcacccacaugaugacuuaacaaccaccuguaacuagcuacagagguccggugcugccuucuggcuucugcggacgacugugcagacaagcaccgguacaaguagaauaauaauuaaaagcuugaggaaguaugagguuuuuggaagcacaguucaaggccauauccucaccugagacauggaaguaagagcuuugaaguuggggaaggguuggauacaaagcccuguuucuguacagagacuuaguggccuuuccccccaccccccacugcccccaaaauuuguuguccuguuguccucuugggaaaaaaaaaaaucaagaacaguggaacagcuuuagcuugaaauuugaaaugcuacagaauccagaacuugcauccauugccucagugccaaggaaguuucccugauuuuagagcauuuuggauuuucagauuagggcuacuuggcagcgucuacgcagauauccccagauccaaacaucccugucucggaagcacuucugguccugucauuucacauacugucaaauaguaauaggaaguuuauguucagcaccaaauuaugggaucugagaucaaaaacaaaaaccccaaacacccacacacaccaacacccccccacacacacgcacacgcgcgcacgcgcgcgcgcacacacacacacacacacacacacaccuuuggagguccagucuuugugcugcugaagagcugagggagccuuagugugccaccaguauuuaguucagaguggugaagacagcauccugggggugggggcgugggguggcaggcaguagccugcucagauggaguggaaggugggcgugagaaccaagggcacuggagggaguugacugaugcuuggguaaugggaaaccguaaagcuuuuggagccugugaucagaggaguaagagcuuucaagaggccgcugugggaccagcacuggagacuggggauggugucacagggaggcacugagcagagagccagggagggccaggccaucgcuagacccaggaucugaggagcaggggcacacugcauagugacuuggcucugaggcauggcagugggggugagugaugugcuggagggguuagugagaugugacccugggcccagaggaggggacccuguagaauguggcccauggcucuguguuagcagcugcaagucugaggucagcagcauaaagcaggcccuugaggaagcccagggugaggaaccugcuucuaguggggucuugaguuagccuuccuuccggagacugcagaacuuaccuggggauuaaaacuggcuucgggaaaaggggucgugcgugguguuugcggucaagaugcuucuuuccuccaaaaauaaacguuccagcuuuccaagaagacacucccacaguuauuugcugggugccucuuucugaguuucagagccacccaggccaaaggagauucuugcuuacuuguaggcugugucgggugggccugaggcuggcccugcccucugccacugcauugaucuuggcucccagugguugagacaagcaagcagcuccuucuacccacguagugccagccagcaugguaggaugauuuccagcccuugccaauguggugucccagccugggcugcgacuagugcauuuuaacauucacuccuuugugacuuuaaaugggucgggcacacggggauucuugaugagaacaguugaggggcuuuagccaagggacagagggacagagcucccagcuggccggccugcaacuggagccauucauuucauuuccacucacaacaagucuaaaaauguggucacacaugaggugcccuaggaagguggcaucauuuggucugugggaguuuuagugcauucugaaauuuacggcauuaagugacucaguuucccccacacacaucccccccacccccaaauucagcaaaguaggcugcagacuguuucagccugcuugcuucauuccccagacuuguuuggcgagcucuguucaaucuugagccucagcuguguccugcucccccggcuccccucuuuccucaucuaggaaacggaaggaagucucgcaaguacuuucuuagugaugcuggacaaagccauugaacucugcccucccuggguuccagaugguggaugcugcuguucuucccagcagaggggauacgcaguggaagauaguuuggaggaggaggaggggguggggaagaacacucuccuggcugugugcugaucggaugcuugccucuuagcuacaccuguugguguugaccaugaagguuucacacccugccaguggacagaaacguuccucgucuguccaucugucuguccuuccugcuugucuucucugccuuuucugucuucucgucguguuccugccuuuaggggcaaggguugaagcaucuucuuccagaagacagaucuggguucugauacccuuuaaaggaggcuccugugccccacucaaguggccgaaggacagaaaugagugguuggugcauuaugaugugggcagagccuugugucccuuugcucuuggcccuuuucaaggaugggguaguaauuggaggucacguagcuucuggguaggaaccagaucgaggggccaagugugucccacggugugugucugcgcacgccuuuaacccagcacucaggaagcagaggcacaaguauuucugcucauuugaggcuggccugagcuaugaagugaggcuuguuuuuuuggauuuuuuguuuguuuaaaaagccaagucaggaguaugggaauaggguggggguuuaaguucccagccagauuuuggauucacgauuugaagugccaagaucuauguuucuagaugacugguaagauuagcugaaguuaagggugggacaaguugaaauccuuugguccuuguagaucaagggcuucccauagggauaggaggaguucccagagaugaccccggcaguauguggagaacaagaaagcuccagugggacccugacacauagaaccugguaaaugaguucuuguaggucagccuuccuugaguacagagcaggagccugccucuuauuacgcuucuagauuccacacccccuuccccacuuccucaggaccugcauucaagccuacccaugccugguugugcuugguaggagguagaaguaucuuuugagcuugggcuauucagccaccuucacaaaucauagucaauaguaaugauaguuugcuuuucuaaccaaacaucucuuaggaguuggagggauuccuuugguuuagagcuaauuccuugagcucagucagccccacuaagucacugaugaacugaagucagagccgcgguugaugcuacuucauaccucuuccuaugaaguugucagaaaaccagucgguaacaagaguagcacguggaaagauuggagccgagagccucggcaauguaaaugguggacaccugaaugugguguaggcuccuccaaagguaaaugcggaguuaccaugauauagccauuccacuucggaguagaugccccaucguguaaacuagcauuuacccauauuuguacacaguuaaugacgagugagguuuaaaagccaaggugaaagcagaccaaggacccguggaagcugauugaguacacagaacgugacguacguacaauggaaugcuggucagacuuaggcggugggucuguuccgagcuguagggaggaugaauguugaacgugguaugcgaagugaaacuugaguuguguguauuucacuauguuuuuaagaagaaaaaaaaagcuguccaucacauugcauagugacaucauaccaugugagcuaugggcgagacauuccaggccagugucccaggccucaguggaagugcagggacaccugggggagcugggugucauggggcugagucugccuucugcagcuggacaccuuuucucccaaggaaaucaaguccagagucaaacgcuagugccggcuaguguuguugccaucccaggggaagcuuauugcuaauuguuuuuuuuuuuuuuuaauuuauuauuuucucauuuuuccagaagagagucuuguuuagauguuugguucccucccugauuguacuggaaguuuuuuauuugcucuaacagcucaacuuuuaaauuuuuuuuaauggcaaauggacugccccaucacauagagagauggaaggaagagauuggaugcaguagucgagaauucaagggucuggaaguugaaacuggccagagguuuuuccucauaggugaagaacucggagcacuuucaaguccgcugcugcuugaggucauaggacacgugcuguggggcuuaggccagcguugccucaacaccuccccagaauguacucuuuggggccagcccuuuggaugugguugucucaaucuaguuuaacaaggcacaggacucaggccuggaccugccgaauuccagacagguagucaagccugucuggcagcgaaaggagcuuccuccaccccagugacccaccgcagcuccucuuggccugugacccaugggaagagccauugcucucugucugcgagucagacuaguguuucccuggaugccagaagcgaaccugacugauccuucuugccuuuuccaaacugguaccccugucucugugugucugcuuugccugaccaucccaugggagguguuaccaagcccaagguggugagacccaucucucacuuggugguaggcaguggggaugucucaguuagcuaauuugcuaucacagauuacagagaccgaggcugagcggcugggacagacaccucuugguaagcgcuggguccagcauugagauaucagcuacuucaguuuccuaucucaccaauaguaaaugucugcuugcuguguuuucauguggcaaggagagcaacugaagacacugaucccauccugugacaguuuccgcaugaccucuuuccagccuaaucuuguuccagagggccuaccuuuuaauaccaucccuucagauggaagacuuggagcuuccaucugacauuuuaggggcacuuagucauccagucuguaacaacagagugaugugcuguaguuccggauucucaguguccugcuauuuauuuauuuauuuauuuauuuuacuuuuuuggccaaaucugagaguggauugcagauuaacugugagacaagugaaacuggacaacuaauuguacauuucagcccuucauauccaugggcucgcauucaugaauucggccaggcacagguuaggaauaucuguaguuccggauucucagugucgugcuauuuauuuauuuauuuauuuauuuauuuauuuauuuuacuuucuuggccaaaucugagaguggauugcagauuaacugugagacaagugaaacuggacaccuaauuguacauuucagcccuucauauccaugggcucgcauucaugaauucggccaggcacagguuaggaauaucuguaguuccggauucucagugucaugcuagugcuauuuauuuauuuauuuauuuauuuauuuauuuauuuuacuuucuuggccaaaucugagaguggauugcagauuaacugugagacaagugaaacuggacaccuaauuguacauuucagcccuucauauccaugggcucgcauucaugaauucggccaggcacagguuaggaauauuuggggguggggagaaagaagacgcaugcuguauugaaacuggaaacuuguuacucauuauuauucucugaggaaaacauuaugacguguguuguaccugguacugcccaucuucuaggggugauugacagaugggggaagugaggcacgcagaugcuuuuugucuuaagacucucccugacauugugggcuuuuuguguguguguguguguagggaucuuggaaucagucccccaccaaugcugagagaccacuguauguguuuggagaacagcaguguguauagcccauugcuuuuuuuaaaccggaugcccucugagaggcccccgcuuacacgugccuccaucucccacuuuaggaaagauaaaacugcuuauuuugagcucugcaggagcuaccugaggacauuauacucuggaggaauuguaacuugaaaacccaguuccacauaacucccugucuuggugacuguggucuuaucggaccucuggaaucaggucagaaguggcucaucuggaaccucccccaggguuccguucuguggagccgacagcagcaccggugggcugcacagguugcagccgcgccaggcccccacagcugcuccuucagagccggugaaaccaugagucuuucuccucagcacauccagaaggcuggggaggcugcugcuaauuguuuauaagcauuaacuguuuaccagucauacuugcuauuuugaaucugacccugcuauuauguuguuuguuucuguucacagcugagccuuaagauggguagguuuuuguggugagucacucccgugaugguaaaaccaguaucgaucaagcuacucugcuaauccugggagccgucuagagagaugaaacagucugaaggaccccuucaccugggacccccacaccccacacccaacccccaaccccagagucucuguauucaggucaggagaacaugggcugucugcagcucugaauccuccaaggggcccacgcuucuuagaagccaugcuccauuagaggaaggggagacaagccccugagagaauuucucagacuccauccagauuaccugcugguguucucaggagccaugcacguuuguggagagucagggacugugugaaguccugggauguugaagguugguuagaguugccugagggcagcugugcugguugcugugaauuccuugaagcuguacggugaaguauugagugucagagcuaagcuggaaguggugaggaaagaccauagugauuggauucuucuuucuauauccugggaauacagggccaccagcucacacccuccacacugaaguccccugggcagauuuauuaccaugucaccauuaaugugugccagcuuuggaguccugaggagaaaaguccccaagggcccagagggauguucugauuugucugugguaccuguggaagagccuagauaucgcuggauucacugucagugggcaguagaauugagccgauugauguugcuuuuucaaagaguagggggcagcucacaggccccuugaaaugcuugggcagagcuaaauuccauuugguagggauuggagagggguggaucagcguucaggagccuguggaaggauauacaccguguaagauacagccacgccuugcuacuugcuugccucgaagaggucucguauuaaccaguuaggaaucugaacagacacacuugguguugcugacaguggaaaccaaggaagagaucauugugucacccaaauucugauguccccauggaggaucaggccugacuaggcuugaggucgggacuugaugugugauggggcucagaacaagguagaaguauauugaggaaugaggccaggcuauggagagcccauuguuucuuuagagcaaaggaauucuuugugucuuuuuaaagaaacacucauggcuccuguuguuugacuaggacuuuaagcuuuuugaggguaggguggauuauagagaaaauaggagaagacugucuccgagaagcuggaggaccucuauggcuuacuucagugggccuugcaaaggcugcucuucauugcucuugggcuugagugcgcugcuugggggacagguugacucaggaugccaggcaaagggccauucagugacuuuacauaacucuuucugcuucccuccuaggucagcauucacuuuuuuaaagcuuguccucuaacauugccugcucaucuaguuguguguuugauccguaaggaaagcaauugggauugugcuauaaauuacaguaccuucccagugcuagaggacuccugacuccuccacauccuacccagggaugaugaagguuccugcuggaguuuuugucacaucaggaaggugcucuguuccccuacagcauagcagaccuaaccacaguagugucugcuccuggguggaguucaugagugucucuccuggauacugguauagucuuuugguaaagugagucgggcaggugggcuggucuaagagcccuggcccaggugugagcauucccccauguugucucucucaggccuuugcaaagccuuuugcuguauuuggccaggaguagugucucccugggaacaaaugaaaguuguuuacaggcagaguaggggacauuuggagauguaaagugccuagcguccucauugcauuccagguucaacuuuggggaggcgugacaaagcugaagugcgaggcagcagacuguguguguagaaagcucucagccccucuuaacagaucaggaaacaaaacccuguuuguagagggcaaguuccaguugagcguuuaauuaugggggugacauuuguggcacuagagagagacuggggcuuccuggccgccucauuuuuuuucuggcccggguucccucgagucuccacucguuuuaagauuugaaaaacuaacguaggaugccuaagauuuuuuaaauuccuggcuuuggagaccugacuacagaaaagagccaggguuuucuggcuggccauuugaggcucugcaguuucucacuuccugcuucauagccuccaggguuuguaaugccugcaggcuucccccuuccaguuuaaaagcagccauugacagaaaaauaaauagaaaaaucucucuccagaaauucuacuuccuguuguugucacugcgcucugacaaauagcuuggccaguucaggcucucguuggggcuuuuucaaagggauucuuggacucuuucugcuuggauagacuguaaggaggugauaaguuaaaagaaccgcggcuuaaucagcagagugcagaggcugcaguuuagggucuguuuuggcuuuuggagcuugugaaugugauacaaguagcagccaucugcacaguuggggcaaacuaagcaccagucgcuuccuccguaauguuucaguguuaauuuuuaaaagguauauuuagacacaaaugaccuuuugugacaccauggagggauugggaauacuuaugguacaauaaggaagaaggauccaaagaaauccagccaguaucugaauagcagacuugauggauauuaccccccccccccugcaguggaccugagaguucagauguguccuugcuguagaguuuauuuaccuaguuugaagauucugggcuccugugugcuaauuugagaaagauggaguuuuacgggugauguauugcuccuccaagugcgugccuaugaaucauuuugucuguggugaguggacacccccuacccccauacaggagccuaagcaguugaagcaguguaucuuguaugcuuggucagagacaguauuucugggugguuuccuagugcccggugucuacuccauagcagaguaaauugguuuuggagacuugguuguuagcuuguugugaagagccuuuagcauccuucccugagguuacugugggguccuccuagaacacaccuguuuuuauaguguaugauuaauugauacggugcaucgguuguguuguauguaucguuauaugauuaauugauaaacugcucugcauacacguuuguaaauaugugugagaugcugugucauuaaauaccauggcuaauugcaguacugcugcuauauugacuauacugugcgugucauuauaauacgugguuaauuaacccacuggccagacagccauguucuggagggaucuuguuucaguacucaguggcaaguccgagguuguacugaaguaaauaagugggagaucauuguccuuaguguguuuuguuuuuucucaucggcuggugggaaugacaggucucuacugcugccuucuggggauuguccccacaauaggaaauggaaaaaaaaugauaaaagaccccuggguggugacuuucuaucaauucuauucaagcaggacuaugauaacuguuaaaccguauggucauuagauucuugaugcuggguccauauucuuuaacacgcccagucccagcugcacuuuuggcuaacaaaaucuuuccaauuucagccuguggcacagagcucuuaggaucggagggcucuaaaucacaggugucaggaaccugugaaggcugcaugcgugauggcggagggcuggcaggugaaugcuccacaagcagcccuuguuuguguguguguuugaagcuggcaucuuuucauuucccuuuuucuucucuggaaaucuagucaguucuuuuaccccucacuggcugaacuuuccacggugcucaccguucuuguacaaaccgucuggggaaaguagcagagacuuuuaauccaagguguuaggugggcagagcgacucuggugguuccuuggauagcaucugguguugucuuccaaagcuggaaggucuguguucaaagugugacugaccaagucuuaggucuuccgaggguagauuucaagcaauuuuuuuuuuuuuuuuguaaagggggugugauuuucauguggaagcagacuuuauuaucagaccauauugagaaacgucagauggguaaaccugcaguggcugcaguggcuugaacuuaaaacuuuugaacuguggaaggacugucgagaugauucaguggguaaagguguucgccaccaaaccucaguucaaucccgaggacccaccuauggaaaagcaacgccuacaaggugugccugccgggguauauacauccacguaauccacgaaugcaaauggaugugauaccauauguaaaagaauugaacuguuagccucccccaaagcaagacauguucauuaugcgugugugugugugugugugugugugugcgugugcguguguguguguguguguguguguguguguguguguguuuguugggggcaguaugggacagucguuucugacacaugauagaaguuguguaaauguaagcuaagacaugacuauucugaguauacuugggucacagacacgcacaucaaagcuugucccuccuggcaagugacugaucaagucuuaggucuuccgaggguggauuucaagcaauuuuuuuuuuuuuuguaaagggggugugauuuucauguggaagcagacuuuauuaucagaccauauugagaaaugccagauggguaaaccugcaguggcugcaguggcuugaacuuaaaacuuuugaacuguggaaggacugucgagaugauucaguggguaaagguguucuauguacccaggagaggccagugcucagaacucggacuuuucuuugcacaauugugccugcacauaacaccucaggaguuucacaugugaccugguuaaagauaaugugcagacaugaugaacagugaacuuuuaaauuagggacaaauuugucugccaccuuccacuacaauuauuuuauuauguuuaauguuccccccucaaauuauaauagcagugaaugguuauuaagggaaaaaugagaaaaauacaguuaggaaagaaaaggaauuaucuuuaaucagccaagagguaucuuaaccaguuguuuucugucguauuuucuuaaagggcucugguccuucaacuuguacauauuuacuuacauauuaagauguaucauauauaccagguuauuuauuauaauuuuccuauuagcacauugaauauuuguccauuacauuauuuaugcugcuuauaucugguauaugguguuuaaggaaauuauuaaaauuagucuggcacguagaauuauuccauagcuacagaauucaagcauuuaacacucucugcauuaaaacuguuauuaagaagcuauguacuauuguuguuuuaauucuuuggguaaaauuuguaacuucuuaugaggggauggucauauuuggggagagcuugcuuggaugggugggugggugagugagcgagcgagucagugagugaacgagcgagcgagugauccaucuuugauaaauaucguagcagugauuuccaggaagcuccagcuuccugcuucagaggcagugccugccaucuguaccgaaugcuaaaaagagcccugacuguaguuuuagcguuaaaacguuacaaucuccguauucuaauuuuuaaaaauugcuaguaggaucuucauccaucaauucccauguuuugcuugagguaacaguuccauagaugugucuaugacuuuuaagacuuaauguaucacgugaucucuucuacauaucugcugugcucucucucucucucucucucucucucucucucucacacacacacacacacacacacacacacacacaccaagucuaagacauuuguugacugacaguacuucauucgaagcuagcacagccucuucacucuuaauucaggacauguuuaaugcuugguccuuuuguguaaaaguucacauucaugucagagucaauucaauuuaaucaaguguaggacuucucauuugucgaauuucuccuuucagucuuuaauaccuguaaaauucauugggcauuuuggugacgugggacaugggcuccugacaguucgauccucucucgagcuaucugccaugcuacaugggcagguuuucaccacugaccugcugcucucagagacacagcccuauagucucagagugcauauuacagccugcggagcaucauuccugcuaacuuagagcaugaguguacacauguguuuauuuuuguuuuuacaagucuuuucucacagugccccaagaaaugggaaaaccgaacaaacaaaaccccucuucccaaacgaagaagcacuggauuuugauugugauggucagauugauguaagucagguuuuggaaaaauaagguuccccaaugcuugagcuacuuauuuaaggcauguuauugcuuuccagucagcuuuuauuuaucaagucauggaugauuguccuuuucacuucugauuauuucuggacguuuuagcaccuuacugcucauguagaaggauuuucuggauuccuccuuguucauguagaaggauuuucuggauuccuccuuguuucauuucucugaugacuccuguguauuggcugagaagguuacgguauuuuguugauuuauuuugcagcuaccuaauccauugauuguucccguaguggugcuuucccacccgaguuccccgauuucuccugugcacagaaucauugaugaucaacaaaaaugcuugccuucguuuuccuaguauccaauacccccuugucuguuuaaggugucaugacauuuaggaaauguuuuaguuacuuguucuguugacguuaugagaccaugaccaagguaacuuagaaagaaaugacucaguggggacuuacguuucagagguuaaguccauggucuccugcugggagcaugggagcaggcaggcuagcauggugcuggagaacuuaaaucuuuuccacaaaugggggagggagggagggaaggagggaaggagggaaggaaguaaggagagaggagggacacacaagcaugagugguggaaaugcaugggcuuuugaaaccucagagcucacccccagugacauacuuccaucaacaagaccacaccucccaauccuuccccaaacagcucuacccacugggaucaagcauucaaauacaagagccuauggaggccaccacagggauagauaagcuaaacaccugccuaauaaagucuuaauucggcgagguaaaggaagucugaagggaagcaguguguggccuuggcagcaugguuuucuaagaggacaugaaggaccagaccccuggcuucuguaucuuuaucauuagcauccgucuuucacccucacggucacaagauggcccccauaucuccagguaccaccacuguauuucaggcaggaagaauagaggggaguuaaaaaugaaggagaaaaaggcagggucaguugucagcggcagcaucugguccacgagcugguccucucgcuuguuagugaguccuaacucaccuggcuaccacaagugaguguggcuuucaagccugcuguggagguggagguggggguggggguggggguggggguggggguggggguggugguggggauggggauggggguggagguggagguggugguggggauggggguggggguggagguggugguggggauggagguggggguggggguggaggugggugggcccugcaagggcuuuucacuuugucuucuccacccuaaagggugcuaaaugcugaucaugcuauauuugucugccucuuucuuauauugauggccaugccugucguaguucuccuuacgugugauauccuuugguuugggaagguuuccaucauguugaggaauuauuugucuaguuuuugugggugauugauuagggauggcugugaauguccucccgugucauuugggcaucccuucggauucagauguuguuacagugugggcgcgauacaggaauagaucaccuagcgguaaucccguuucagauuucuuugagaaaugacuugggcugguaguggggugacuguuuaaaaaaaauucuaauuaaauuuagucagucuguuaaaugacagaauucaguuuuuccuuuuuaucuacaguuugaagaaggauguagcuuuauguuucucuuugugugcguucuuuuccagauuuugcugucugguuuaggccagcuuuguaagaugaauuaguggcuuuccuuuuuagcuucuuugucauggcuuguauaguguggcaauaagcugcccuuuguuaaaagcuuagaagcuaaugcucuaaaaacugcccaguuuugucaguuucuuaaaauuugucucuggguauuggugugcaguuggcuucugauuuacuuucugauuaguuuuuggaauugaaaauaaaugucaacagauaauuaaaaacacucgguuguaugagggucuccuccccacccuugagguggaggugagggcugaacccagcuuaccacugagcuaaauccccaagcccccauguagcauuuucuucaugauuuucucuuucauuccuggucagaccugccagagugcuccuuguucggugcuccuguccaaacaguugguucugucuuauuaaagcaauuaugccacggcauuuugcuggcgauggguaaccucuaucuuuuccuggccuugcuggguucauauauuaucagugacuugaugguagaggcuguagauaacaccuuuuggaugcacaccuggcuuguuucagguaacccugaggauaguccuguggcugugccugcuggacguuuucauuggcucucuguaaugucccgugaugggugccgagaguagaugccaccuuaggaccucuauggagagggaaacauuugcauaccuggguucaucccaaggaaugcauuaaagacaugugugacucuacacauggcucuauauguggguccuggggauuugaacucagguccccaugcuugcacuguuaaguacuucgcuugcugagucaucuucccagcccagauuauguuuugauggaaaaggguaucaauuguaauuagaaggugguuccccccccccccgccccuuuuuaaaaaggcucccuucaaaauuguugcugguuuaauuaaagaguuuggcuuuguuguuaccuuuuucccuuagugacccagaaaccaguauccuucucuggguugcuuuuaaauuuuugccugaucucuuauguagggcucacaugguauacgcaguuaaacuugacuuuucuuguuacacauuuuguucugaagaggcauggaggcagcauucguucuuccagacuugacuaauccauuugugcugguugguuuuugucaccuugacccaagcuagacuuaccugggaggaggauccucguuugggaauugccuaccuccacuagacugugugggacaugccugggaggucuuuucuugauugcugauugauguaggaggacucagcccaucgugggcagugucaucccuaggcagguaggccuggacugagcaagccaggguagccagccagaggucaguauguaaugaucugccauaguuucuucaauaaccggcuuugacuucccucagugauggacugguagcugggcauguaagaugaaauaagaccuuuccugcccagguugcuuuuggucaugguauuuaucacagacauagaaaacaaacuaggcuaccagcccacagguggucuaccugcccacuagaauguguaguauaaaaggcuggguauacugaccgaccguggggugcugggauaguaggccaugucuucugcuuucuuuaaaagcauggaagauguucauuauuuauuauauugauauuauuauuaauuauauauuaagcagccaacaaaguaccugccacauagcagguauucauuaaaacagcuggacugcagauugagacacauggcuuuaaaaagagaucuaauuugaguauggcacuuggaauggagcuacaguuuguuuuaugaaaacauguuuguaauugcucagauggucuauauguuuacuuaggauucaaguacuguguagcacgcugaguguuucacuggucuccaguugugcucuguccccugggggugggggguggggguguucuugugugaagacgagaaggcucuggagaaucccuugggcuuugcagagagguucuuaaggauuggggucaucuuagcucugcuuaguguaauacacaagaguuuaguuuguuaggaaaauuuuuguugguggaacuuucuaaaaaagauguuagcccaguggugguggugcaacaggacuuuaaccccagcacuggggagggaggcagaggcagguggaucuuugaguugaaggacagccagggcuacgcagagggcguccauuuuggguggaggggagauguuagggacauuguggagugcaggcaagugaaugcccuuuugggcuagcucaucucacgggcuaguuguacagucuccucucucacagccagaugguaagguuuauuguugaaaguuucuggguuuuuuuuucuuuuuuuucuuuuuucuuuuuuaagcuggggaaggaagagucugcauagaacuggagaguuccagaggccaagucagggcacgaaggccauggguauuuggaaaucuggguguaguucacccuuguuuuuaauuuauugggagucucugacagcugauaauugaaccacaugugugcaguguuugagaggucuguguucugacccuguccgugggugcauucuuugggauccuccucaggcugacaggguugcccugugcacgggcaucuuggccagcuggcccucagaguagauuggguaggucaguguuuguccucaggcuagguugagccaguuaucaaaucacuuggggguguuuugacaggcucagaaagucucaaaaaaaaaaaaaaguucugacuuuaaaaagguaaggaaauggucucccagugagacgacuucugucuaagaaaaaaaaagcuucuaagacauaaauacuguauuauaaacaacuuguaauuuucauaguuuucaguguuaguacuagcagcuucuaugauagaucuuaaauauguuuaucacagcuggaaaaauguuguauugucauccuuguuuaucauaauaugccaccuacucugguugugccuuacaguguagcccugcuugcuuuaugcuuuaugguggggagcuggggugggggggccugaugaauacaaaugaaaccuagaaaucgaaauggagaagaagaaaccuauucagccaggacgcugccuuuacagugagagauuaagacuggcaguguccuacacugugguuuauugaauaauaaugccuaacacagccugagcagagacccuucgguggcugucuucugaacguuuugcagacauagcaagaauguaucagaugaccacgggaccuuuguuucucucuuuguuaaagcuaggugaauuugguuguugggauguugcaguguugcaguuuggagauacuggaggagcggaaaccuucccucugugcgccaggagaguuugugguuguuggcagucuggcuucucaaucuguccaaugcucguccuugguggcuaugauuugagcaaauaacauuagguauuugcuauccuuuaugagaaguuugaccucguuuuauuagaaccauauacagucagcccucugcacccacugcuucuacaauggcacauucuacuaacgucagacugagauaauucuuuuuaaaaaguacaucuuuaugaacagcacagacauucucugugucaguuccugaacuguauagaguaaggacuauuuacguagcauuacauuguguuagguauuaaacacgagcuaagcaaccuaaagauguuuaaaguuagauaacgauacaucacucuugauuaaggaauuuaagugugaauuuuguuaaccaaagagaagugguguuuccaugaauuguuucuucgaauaugagaucgacccuauacugacuuuuuucguaguuuugauuuuuguccugccucucugcuugugauugcaugccauuuguuaacauaauuugagaauugcaaauucaucuuaauaauuuccaagaccacaugucaugaggaaucaaauuacaaagcuaaauguaaaccagagugagcguaguuaacauuucucucccguuccauacucuugccuagagcauuggauuucucaauauugguuccuagcguuucaaaauuguauuuaauuuucaauuugaacuauugacuuuuaagaacagugaucacaugauuucugagaaaucuguagaaauguuggcugguagacgaggcccagcaauguugaguucugucgcuccuggaauuggccccucuguguccccuaugagguguaacuagccaaaggauggccucuagauaugguacagcgguuuccguggaguugacaucugccuacagguuccuucauacccaguuggauacuucuuucucaggagcucagcuacaagccccugccccacaguggcuuaucuagagucuguaucugcggauuguuguccauugucucgcuaaagaugcuuccccaacucacuucaccaaagugacuggaagacaguaugugugagguguauguaugagguguucgcggugguuauauugguggggcuccccuccucaggcugauccaagucuuggagcuauggcuuccuuagaugauagggcaacuccuagagucuaaaacugccuacagccuuacuuuagaguaacaggggaagguacuauucaggugugaguuuauuuugauguuucauuaacauuugaguuuucuuuggaguuuuuggagaccuucacuggaaagccucaaacuuuuuuuuuuuuuaaugguuuuagagcuuuauuguagaaaggcagagagaaaaagagaagguagaaagagagagggcggccauggccaaguggagagaggggggaagggaaagagaggaggagagcuagagaauaagaaaggugagagcuugagugagccucaaacuucuaauccuccuccuucugcgguggaccaggaugccuggcuuaaaacuuaauuugguuuuuaaaugguaacaauuuaucauuaucuuucacuucccuuuaagauuguaggugagugauacuuuguuuaaauggcgcugggaacugaacccagggcuuugugugugcuaagcaauaugcaggcugccaacgucgcaucuauguugcgucguuuugaagugcaaaguccaguagcuuagaguacauugcauauacccccacccaucuccagggcuuuuaucaguuucucagacagaaccuccaguaacaccaguuccuccuuccuucuguccgucugucuguccaucauuuguccuggcagccaccauucuuugugucucuaagacugcacuuagucaccucagagaaguggagucauagucuuugccuuuugugucugucuuacuuuucucuguguacuguucucagggcccacccuuugugugagagcuuuguugugaguuggagugauacuccaguaaacagugggccugugccacauuccuacacauggcaguuaaugcuuacccacuuaucuuuggggugcuuggguggcuccccagauuggugcuuaucaguaauguuccuauaagcaugacauaacaauagcuuuucaaguuucugcuuugaggcuuuggggggcgggguguaucuccagaugugguggggucauaugguagcucuacuuguagauuuuugaggaacugccauguuacuuauuuuguaaucuccccuuucucuacccucccccuuucugugguguugggaauugagcaaaacauccacacaugcuugugagugagcccaaccgugaguccaguauuucaaauuuuugucgguguaaacgggcggaaaccugaggguuugggaaggaggaguugagaggagaaugcuccucuguguggacagcaguuagccccgcuggccaguauucacucagcacccagcauucucaggcccuuggggcagagaauaacaaguguguaguccuagcuuaccuggucgaccccauuccaguagucaucaccgcucacauucaggagagagaggcuggggccccauggcccugaggugaggcucgaaggcuggcauccccgaagauaggugucaggauaaaggacuucuggggagcauguggaugugaagccucagguggcuucacagccuuuucagugggucacugauaaccugugucccucugucuguugucgggagaucaggguuguuuuguuuugccacuccccugcugguuagugggagaacuuagauacucucacuccuggugucaguuuacucauauggaaaauggcaucacagaugcuuacagccugaaggucacacagaccuuuccagugugauauuaaugccuuguacauguuaggagaaagggugaagcuuuuaugagaugucccaggggauccaggaccuuagaaagaacuguagaucaacucuggggguuccccuuucgccaacugugcuugguucucccguccgugccgaccggacagccucacaggccagcuccuccucugcagggugggugagaguguucgcugcccagauguucgcaucaaguaaacagaagcucagucaguguuagggaaauuaaaucacccagcagaaaucaauguuagugaaaugaaaucacuugaucuuaaaagcaacaauggaagagccauucuucaucuucauugugcuguugcgcucucugcauggcuuacagugcguauccuuucuuguaucccugucaaggagagcagcuuugguugguuguauuagauuuuuacacgcugugguugaggcuccggggauuuguaaucagcugauugauuaaucaggaaauguuaaaggauuagaccguauccagaagggcugccuccuuugacgacucagaaggcaggcuuguucccuagugcucucugccacugcggaugggggcuguugagcacaugacacaucacaugggccuuucuggaugcuucgacaggugguagugcagguacugagagcggaccauguuucguagaugcugcuaccagccagcagugugagcgaaggacaggccacccuggagggcaguuauaucccuugugcucauccucaugaccaggaaacuagggcagaaggaacaucgcauauccuggcuuuagaagcagaguuccaaaauuccuguuggcuccauugggugagguuuggggguuaaggagguggaagaggcaaguaauaaauuauaaagauucgugaucguuuugaugaugacgguuauugaaaaaauacggugguaaaguacuuaaacagaagguaguaagaacaccaagcccccugcugcuccuccucuuccuccaacucuuccuccaucucugcugcucccagaaggcaggcuuuacaauacgucuuuaugcagagcaagcaugcuguguccugcucuauuuaagaacaaauuuauguuuuguaauuuuucaaauuaaugugucuuggcucucuuccuccaguaggaugaucuuuguucuugaauuggcuuugaguguuacgaggaauacagccgcgugcuccugaguuaaagcgagcaguacggaaucacagaguugagagugguggccugcccucuccucucccugccgcucugcggagggagcugccaguuggucaguguccacgcagggggugucgagaaggaaacugcagagagagaauaaugauauuucuuuuuaaaaaaaaaggacaucaucauugcuguccuugaggccugcucuccugugcacacaagccuccuugcucugccuucuuaaguagacuuucuuuuagaacagaguggggcuuacagaaagaguguuuugguagcacagcguucuccuguacacuguaacugccuucucugccagcacccuaugucaccacagccugugagugagcugaacucggcgucuuccuuugagcucucuccagggcauugcuacuuugcuggcagaggucuccugcaggacaccucuccauguuaccuuuagcuguuacguccucucggccaucucugagccugugacaguguuuuagcucucuguccuccuuggccauggugauaguuuuaaggagcacuggccagguuuuaugucccuuaguuugaauuugucuaauggcguucauaggauuaaggggaaauaugaggcuuaaggagcagagccgacauguuucucgucccacuguguugugggaacggcccugccaaaguaccucccuucagguguguugacauugaucccaggaugaagcucacagaagccagcugcacaguccccauucuuuguaacugccguguucccuugcaaugucuuuaaaaaggauuuggguuuuuauaagucagauccuuugggauacugucaagugugccuuccuuuucauccaaccugugcgagaauggcauccguggaagagaagcuaaaaugaaucaggagagugggcguggggaaugaccgauggauguguccucccaaauggcugugugcacccaccggaagagaacugcugcggccccgacaccaugcccaagaaugguacuguuagaucuguaauuucuuccuguaaguucaguaagugaaaaacaucuuauuuuacauucuucucauugcgagaggcguaccccauaccccggaaaccuuaacgugagaugaaggcgagaacaggagccuccagugacauuugggaaacaccuguuuaguacgaagcucugguaaaaauacgcuccaaacgaggaucuacucaaggaaccaagccuuuaucucagaguucuuucccacagcacauaccugcuguguuaccuuuggucauuggcccuaccguuuaacuguaguguuagugugaaccuguuuucucucuuucucuguguguuaugaauacauguguguucaugcgugguuuugugcacacguguuagcauguggaugggggccagagguugagucuuccucaaccucugcuuuaccauaacuuaagagacgggguuucuuagggcacccggagcucaucaguucagauucgcucucuggcuagcaagccuuggguccccagcacuggggcuauaauugcgugucacuccugccuggcuuuauuccaugggugcuguggaucagaccgaagcacucagguuuugcagcaagcgcuuuacucacugagccaucuucugagccucaagccuguuauuuucuguucaaugcuucauagaggagcauaucauugauggugaggacacuggggacggaacaaacucguuauccagcaucaagagagauucagggugaggggaggcuggguagacauacgcuaggagacccuacucuuuaguuuccagggucagauaucccuuugcccugugugcuguuugcccccagcuuugauggaagaacuugaggcucacauggagcuuggcuuugguguuuccuuacuggggcugggugguccucacagcuuccuaugcucaccuccagcccuccuggcugaucccgugccagcauccuugaggucugugugagcugcggcuggcucaggggcccaucacuauugguccugucugagacugagcagagaacagcaggcauagaggugguguugacgaugggcagugaguguugaccuugaugugcuugugguaccaagugcaugcggcaggacaagacuuaguaccucuuguacggaggagcgacuguuguuugagacuucuccauugcugagagaucuccugguccugcaccuagaguuuuguuccaggcaaguuccuuguagaggcugauacacauagcuccuaagcagggaugcugcugucuucugcaagagccauacaugcaagaguuguacacacaggcuuaguggucuccaaagcccucugcuuccugagcacagcuguccuucugggcuuucucugccuagcagggauucguuuguuccucuguagaaugaugugcaauuuucugagcuccucagccgggguggaguucuuccaggcugucccuuuauuauccaaaagaggaggaagugggagaguuucucucuugagagagcugagcuuagaucugcucagcugagcucaucuuaagucacagucccugcuaucugcuaccaagaagcacccuuuguuuagcacuuaagcuagauacuuuugcauucccagcauuugguuugguuuugcauaacuguuuauugacaauaugguguacucaccuuuaacuuuuaagcaaauuaacaccguggcccugcuaagguaagagagggaaacaaaguugggugguugcuagaugccugaguuggguccucgcagacauaccggcaccaaguauucaugugcaccugcucugcgcuggacucuggucucacucaggaaccuaccaaguugagaugccggcccccucuuccauccgagcaagccuauaggagacuuuuagguccccauuuguuguguguuguggcuuuggggacuuuggcugccucucugaauuagcaacuguguguggccaggcuaguuuucuugucuaaggaccccagucugugaucagggucuccugccugcuuaguugaaggaguugguacuagccuggcaucucacugaggcaggguagcuuugaagggaaagcuugcuugagaucaucagagcacuccauguacuugagaauuauauuauucucagucagaaccuguaaagacaacaaauagaacaauaccacccaggggccaaagagauggccauguuaggggcauucgcugcucuugcagaggaccagggauugguucccagaaccacaccggguaguucacaaguaccucuaacucuaguuucaggagaucugguacccucuucuggaugcuacaggaagcaggcacauccauauccacaacaccuauaagaaaacaacaacaacaacaaccaaaaacaaaacaaaaaccaacaauaacaaaacaacccuaaaaaaauguuaaacuguacuuguugauuuccaaaaaaaaaaacauguggccuuugggguggcuuuuuuuuuuuuuuuuuugcacauguauauaugcauggagagggggugugucugucuguaugcauguguguucacaugccuguggguacacugcuauauacaaauauguggguauggagucccaaaguuuguaucacaugccuuccaugaucauucugcacuuuauuuacugcagcccccgucucguggaggcagggcucaucagcggcagucagucuacuuagcuacccugcucugucugcuugccugguguuggaguaacaggcagcucccaugucugccccccucccuuucuuaacucagugcuugcaaucugcacucuaggccucucaauugaauggcaaguguguuaccuacuaaaccauuaaaucucuacugguaacuuaaaaaccaaaaacucuucagguucccucucccuuccccucccccucuccucuccuccccuccccuccccccuccuucucccccucucccccucucucccucucucccucucuccuccucucucuuuauuuuuuguuuuguuuuuguuuuuucgagacaggguuucucuguauaguccuggcuguccuggaacucacuuuguagaccaggcuggcuuugaacccagaaauccuccugccucugccucccaagugcugggauuaaaggugugcgccaccacacccagcccucucucuuuuuaaaaaccaaaaacucuucagguucucucucucucucugucucugucucuccccccacccccgucucugucucucugucguguguuauaugugauguauguuuugucuguauguauguguggaggcuguguguguguacauguggaggggaggucacaggaugacuuuggacaguuacgucucuccuuccaucuuuacaaggguuccagugauugaaaucaggucaccaggcuuguacggcaagcaccuuuccucacugauccguuuugcuggccccacuggugggugguaggucuuacugucaggggcucuucauauaaucugaaugccagcaucaaaggaagaacgugcagugaaaucagggaggccagcuucuccaggccuugcagagggaaauuugaaugguaucaucuaagugcuguguggaagcagcugucugcuuggggguugagauugagaaggggaugugauuugauagagcuggggagugaauggcagaugccugcggaugcuggagucaugggcuugaaguuccugagagaugcucugcccucgaaggaugccugcagaguucuugugguuagguuguguugucgugugcuuucugucuucaugucuuccuaugggcuaugguuucugcuguugcacauuuuuauugguggaaacacaugcuuuuaaggggcagccuuucacauacgggcugacaaggaggagauggaaccuugcuuuucauaguaucuuucuuugagggaucaugagggacuugacagaggucuaccaggcaccauaugaaagugccuacacugaucagauggcucuugguacacgguaugacagucccuccucagcccucuguaccuggaaguaacauccuuuucaaccgcgagacaucucuuuaaacaagaauacuguaaaacugcacgcaguaauuuagauuuaaguccuuguccuuuccccucccccauaccagugugaucccugacaggccacaugguccuaauuuacguucuguuuucuuugauauaaaacaaggcagauaaagggcugaagauggcacaucgguuaagagcccuuacuguuuuugcagaggacccagguuugguccccagacagcucacaaaccauguguaacuccaguuccagggggauaugacuccgucuucugaccucuuuggguaccagacauauaugugguacauauaaauacacaggcucucauauauacauacauguaaaguaaaaauaagucuuaaaaccaaggcaaauaagagcccaagagucucagugucaaugcagucaggcuuaugaaguuucagaacugggcuacaucguagaaacgcucaucaccuuuaagggaguguaguaugcuuuacaaugagucuguccguguguguuggcuaaaacccuuggucugcucuucccagcaggccacaugagacccaaccagcccucccuaggguccugacaugcuuaguaucuguagcugugccuugugacaggcuuucugguuuccaccccuucuugccugucaaaaguauugaggcaggaacaaacccagaacuugggggucucuucugccaucucuuauucuacuaaggaccacuuagguaucaccuaagauugucuugacuuuuugggggugcaggcacaacaccccaucaucacauacagaaauuauaucuaauuaaguugccuaagucuuuuucacaccuccuacauuugcacauuucuuuuuugcacccauguccaaauaauauuauuuccucucuguugcaguuccaaucuguugaucuuuuuuaguucuugacucugucauccggugcaguugcuaucuccccuggaaacuugucccugauuagagggacauuuuauuagcauuauuggugauguuacugauaguaaugcugaaguagauaugacucagaaggagcaucauggcccuucuucuacugucccuuagucaaucagcacuucggacuguuacugagccauuggaaugcaguucuccuugccucauucugucagcagggaugugaugagauuguuuuacguagcucuguagacaaagcaugugaucuuggaaacagccacuuugucagggaagggaaagauacaagacagaguccuuaccugcuguggugucuaugcuagcuuguggaccauggcccaugacuugauucuccaucaguaugcuucuuccaguucagccuuugguugaugaugguucaaggaugcacguaaggagauauuacucucauguuugggcucauguacaagguguugagaugaucugagaaccuaggugggcauugguuucagauaucuucuccuggaggaugcugggagcagagcuuguggguuguuuggccuggugaauggagccuucuccauuucguggagaaauccuaaauucugagaauguuuggucuuagugaguacagcuugccucugaagaaauuagggguucacaccauccucuagauaauuggagaaugcaaaacaguaccacucaaaaguggguuguccggaggugacagagcaaagcagucaaugcagaaguugcaggagauaacaaaggccaucacgugacuaggugaggugaggaugauggagaccagggaaggaaggaguaguaggagugggcagguuggagcuauaggaucccccuuuccaugauacuuuacaaggcaagagcaguguugacauucagauagacccguguuuaggaaaacaacccacaaaugcauaaagucaacagguaggggucagugguagggggugucauucuguccuucagucauaccagauagugacacguuacaguuuaguuugcaaagauggugaguuccaugugguguuguggcuucugccugauccagagagaugggugcagacgccuagguacuucaguauguuugccaguuugccagccgcguguuuagaacuuaucuccuuggugagucagugcaggacucuuguggggucucugccuggggucucugcaccuguguguuugcacugugguaaggcuguggccaaaccugccucccaccccacuggacucuccuagaccuauggaugugugguccauguacuuuggguugguuacugcuguuucacacuucauauuuaucuaggguuugugccucagcaccuacaguggguuccuugccauugccuuguagagguugaggcucuugccaugcaaguuucccccuuaaacuugagugucuucugggugcucuuguugcuggucuggccugccucucccuguguucucauucucuuuuccucuucucuguuucugucucugugucuuucuggcaaacucccgcgcacacacgcacacacacacacacacacacacacacacacacacauccugcuuuugacuugcuucuguugucugucucugucccccacagucuugacaucagcugccuaauugcagggacuuaucuuccugagguuugguuagguuaagauuucaguaccugcuuaaugauuuuaucucuguuaucucagacuuguauucuaucguaucucgcaguuuauuugucuacauagagggcccuuagcccggugugagugugcagcaagcccguggcagugccucugugucguuacugcagaaagcacagaaaaccuugucacgggugggugggcuuucauuucugccaggauggccacuucacgaagucuaaaguugucacugcugaguucccagcauauggguagcacuuagcuuguaauaagcauugcuuacauuuguauuggaagaauuaauaaauuuagucccaaaccugcaucuaagccaugagaaaaacuugaggccuugagugagaguggcugguuucaguccaucuguauggcugugggggacucaggaucacucuaacagucaccaagucagaagcucuaugcuucaggagguucagacaggcuuguauaugaccgugcacacacacacacacacacacacacacacacacacacacacacacuuuauauguauauuuagacauguuuuuuuauuauuauuauuagccacacauggggauggagcccaggguccugugcaugccaggcaagggcuguuccacugaauuagguccccuagcccaaggcuuauaacuugacacaccauggagaaccacuuccuaggguaggaggaacaugugagugaaugugguuuccacccugacuaucagcuagauaucgguaacugguucaucaacacaagcucaggucacuuaaggauacuggaacuuuguagggcgaaguaagacacugaaggagugagcaugagcacguggccuguaagcagaaagauguaaccggucugacagccaaagccagcgugcguggguaugggaggacagagggacaaccuucacggagaaugcuugccugccugcuucugagcagaaaaucgcaagucagagaaagaaaaggaaaggagggguguaucucugcaggguuucucugcaggcccauacucagugggggcuuguucuggcuuggcugcuccucaaagacaccccgacaccccccccccccagucccaacaccagcuucuggcaguauaguucacuguucguaguacaaggugaacaugaagacauaugcccugcugaggcucaguccuggggaaugccucauagggaggcagaacacugcuucucugggcccccccaccagguguggcauggcagggacugggcccuguaugcuguuuuuuuuaugaaaugccaaucauagggaguggagauaauaagaaagguuucgaaccauuuccaaggguguuauuuuaaagaacaagcaccuugaguccuggacuuucuggguauguuaagacgagaauggcaugucaaaucucugagcaggccagguuguuuuuaugacgaucuguaaaaacagcugcccuugugcagaagugagccccacuucguucugcacagaucuguuugucuccagaugccuuacguggaggggacacgcgugcguguucuuuugccuuggaacuaauucccuguaaauuucccacuucuuaauuggcaggauaggauaaaaaacgucacaucagucucuguaaauuccuugccuugguuucaguguccccaggguucagggcugcaauuuuuuuuuuuuuuuuuuuuuugugggcauagauuuuuagauuguuucuauggugagacagcucuucugucgggcagcaaagaacaauuugcacauucagauuacacuguuuuauuuuaauuucuguucucaaagucacccaugucauggaaaucccuuacauuccugccguugcccucacuuauugacuaugucagguggccgggcugucuugucugugugaaagagaaauguacauauacaguguaaacaugucugcguugacacaugaagauaaaaggcuuaacaugaauugugucuguuuacacucgacacagaaauucuccucugacaaacuggaguaucacucgugcuuguuaccauaacacucuccccccuccugucugguuuccuggcuaguuacaguuuacagcagggagagguccucuucucagagcucugggauggugcucucaggcuaaucagcugcugugggaggacuguggauucgccccccuuggucuuuguguguuuucugcauugucuauaugauauggguuauuuuucucagcuccugacucaguggguaaaaaacacuugccauacaauuauggagaccugccuguguuagagucccaagcaguagggucaaagcaaaacauaagaacaacaaaaacagguauggcugcauguaccuggaaccucacauuggagaauggggagguuguggaguccaggaguuccauggccagcuaacuuggcccaaauggcaaguuuggggcucacugagaaccucucugaaggcaauaaggugggaaacaguagaagacaauccucugcuuccucuaugugcaggcacagguauguguaccugcauaaucaagugcaugggacacacauggaggggggagggaaaggagggagggagggagggagggagggagggagggaaaggagggagggagggaaggagagagggaaggagggaauauauacaugcacauagguuuuuccaugggucacacugcagaucuuggugggugcagagagaggaggggagggcagggaaggggaggggaggggaggggagggggggugggguggggugggguaguaacaaggugggaucacgucuuuccugggucuccuugugucucagagaaugguagcugaaacaucaaaaucagcauguggaauuucucagaugcagauuuuaggaccacuuugugauuuagcaagccuccuugcuagguguaacugagcucuacugagcgcuguucuacugagcucuacugagugcuggggccuuugaaugccugucucccaugcagaacaaagcgggggggcccuuugagugccaugucucugucuguuuucuagccucuguucugccuaaauccuuacuuuuccucuacuccagcuacugcaccccugccugggguugguucccucaagcugccaccacgacccacucagcuucacacuggcuccaggacugcccgggaagccuuccccuuacacucuguuagaccucauuugggguccuagaaacagaaaguauggcaggaccaucuucagggauccccuccugagccaucuuccaggccccuuuagcgugagagagcugugagccucuuucucuauggucccagaguccugcccauugcacggcaggauauuuuccccaucagcucagcaguuacuggagaaaggguuguuuguuuacucuccugugcaaaguucauugacagugauccccugccauuuugacuaacaaaaugauggcaucuagaagugguuuuuguucacuuaguuacugguaccaguggauucuuuuuuuuuuuuuuuuuuuuuuuuuuuuuugagaugugacuauugugggcgagccacuggcuaagccacacugggcuucuuucacaaggcaaaagcuuuguuguguugggucucacucucagaacuggaguuaguuccccaaugugucuuuaguccauugacccauagucaacacaagauucugauucugcucuguaucuguuguuuccgaccauaaaccaagacugucugaaggaaaguugaucgaaauugaaaacauuuuuguuaaauggauaacaugauauucuuuguguguguguuguuguuguuguuguugauagauuagccugcuguuuugccagcuuccuuucucuucaucagauuagcaauauuuagauugggguaagagaauggaggggucacuaaugcuuucucagugauguagccuucagcauacauaccccugaggacagugacccagaacuugccugacgucacugugguagcaguagccuguuuuacagguuuuacaguugaggcuuagaggugguguuuguccuuuugagggcacgagccaacagaagacauuccaaaggguuuucuaggauucaaaccccaguuaagcgcuuugucacuuuccaggaccccauggugccuugcgcagggcagaugcugaacauggaaagcucacgcagacguucagauauccagcuuuggaagguuuucucagucagauauuucccaucagccuugcuccuaauagaagcucuuagggauugguguuccaaguccguagaguugaguuuggcagaacaaaaguucugccaguuaacuuuuaggacauaccuaggaauuuuuggaaagacuugacucuugcaccugaaaagcuuuauuuaagaugucaucuuggcagaaaugaauuuuuagccuggguggcaugcuccugccugguggccucccaucguuuuugcuucugcuguccucauuccuagguuggacccugcagcagggguccuccuucagcuccuccuaacacugcccuuucucccuguuccaggggaucuucauuuccauguguuuuuacuauucuuugcaggccaccugggaucuuacauguuuacaucuaucuuauauccugaaagcaaguguuggggucucuuuggggugugccaaguaucuguuggcuuugaaagggagagaguguuucaggccugacucugccagcugugagcagagggcgugucagcuucacgugccuuccagugcuuucuccagugcguggauucuuugacaggcaggcgugggacauuugcuuuccuguuugcggcuugugccuuugaacaccguacuaucauucacaguccagcuugauugcucucuuuuucugucacaaaacacccaaagaccagcagugucggucagaauucaaagcagcuggcugcugggcccugccuuguauuuuguggcuugggcucgucuucucuuccggaacaaggggguaguuucucccuauuuuuuuccuuuguucuauaaaugggaaugagggguguaaauaaggaaauggcucuuucauucuaagacgcuuccagucccagcucugugugacaugaggccagcuggcagaggguaacaggcccuucguacugucuuuguacugacugcaugugaaagacacuauauuaugucucuuucucucuguuucuucacuugguccugaacuuuuaugauuuguuggguaaaauaccaaauuacuugacacauaauacuuuuaugauauggucaaacacauguugaauacagugauguaguucaauacuccuguaaagucuaagagcaaauuaauacacuuaauuuacagugguauaggaggaguaagauauuuuagacugggcacucgauuucugacgagugauuuggugccauuauucucgugggcuuugagucauugagcagaggcuggguaaacaugaaguggagagaugaggcuugggggagaagaggggagcugaagaagaguuggggaacuguugaagcucaggcauuagcacagagcaagcaccucucugggcccaaagagagaaugggguagugugaaggggaguccuaucaagguagugugaaggggagcacuauaaaggcagcaggccaugaaagggaggagcugagccuguuggagguagugaacaagugugcuaagcaaagaugugcuaagaugagacagaaggagaugggccugaacucuuacagaauccuguugacuugguauuuggucaggguuggacuggacagagggguguguuggaggaagauguugcugucacucaggccaaagaugacagugguuggaucagaguugcagagaugaaaucaggugucuuaguuccaguuuucauugcugugaagagguaccaugaccaaggcaacucuuaaagaggacaacauuuaauuggggcugccugacagauucacagguucaguccuucaucaucaaggccggagcauuguagcauccaggcaggcauggcgcuagaggagcugagcuuuugauaucuugaucugaaggcugcuaggagaagacuugacucuccuaggcagcuagaaugagggucucaaagcccgugccuucauugucguacuuccuccaaugaggccacaccuacuccaacaaagccacaccuaccacaacaaggccacaccuacuccaacaaggccacaccuaccccaacaaggucacaccuacuaauagugccacuuucugggccaaggauacucaagcuccaccacaggguacaauucauugugcuccaugugugugucuucuggugucugccauguaucaagugguguguuagccucuggagacaaaacuugagaacuaaauagaggaugauuuuccauccucuggaacugccaccaugauggcagugagcagaauggagagaagaugagaagaaaggccuagagcuaggcucccaagaaggugggcguaccccgagugggaaacaauugggcuuggaggugagcagugagcaucccaaagaggaaaaggggguucaccaugagaaaagccccuaagaacccacuagguuuggaagggaauuccagaggcggguguuacuagguggcgugugugcaggugagaggcaggcugaauugggaagccuuacucucagcaccagcaaguuacauggcagcaucccugaucaagaugugggagcuggggaguaggucagugccaaggaaguggcgccauuucuucugucuuaggggcccuguuuccucuucagaaaaaugaggaaauuagaccaaagggauucucaaguucuguccgcucuucugcuuucuaccucacccucugauauugcccaguuccuuccuucaguggcugucaugucuagggaaugucugcuuccuuuccuccacuccacuguucuggauuccccccccacacacacacacacacauacaaggccucccuugggcuucucuccccucucggauccuugagaggggcuccauccugugagguagcguucauccccuccugagauccuucucaccaggcuucuaccagccuccuuuccuuugaucccucuuuguauccgugaccuccugucacccugccugucucuggcuuccauaauaucacaggcugcuuaaaaccccaucuuugaugcuaccucuacuuuguccuguuggaaauggugguaggcuuucccuguguguuccuuucaucuuacccugucuauauugacaguugcuugccauggcucuuagugccuggucuuuugcuaugagcccauggaaucaaacuaauuaauuacaugggucagaaaacuuuauggcuccugaacagcuuuaauaaugguugggauuauuagaugcuaagaaagcauagugaccaaggcugucuuuccauauacauuucagacuuuuuaaaacaaaagauuuagagucuagaagaugguccagugauuaaaaacagccuccaaauuuaugugauucucaacuucuguaacucuagcuucaaagacucugacacccccucuggccuccgugggcacugcacucaugugcauagauguacacacagauagcagagucaaaaauaaagaaaaaaaaugaaacaaaaaguucuaguauuaagaccacuuuaccaaaaagacacacacacacacacacacacacacacacacacacaaagaaacaaaauuaauacauaaguaaaaaguuguaaucugcaaaugccuugggcuaguuccucuacuuccaggaucuguucuaagaaagugcucuuggauaucuggaauauuguuuauaaugugaaaaauuagagaugacuaauuaacaguagagaaucagaacaagggacuaguacguauuaauaauuuaaaacaaguuucucugggcuagagagguggcuuagcgguuaagagcacugacuguucuuccagagguccugaguucaguuccuagcaaccacauggugccucacgaccaucuguaauggaauccgaugccuucuucuggugugucugaagacagugacaguguacucacauauaugaauuaaauaaaucuuaagacagccaaaaucaaaacacucuaauaaaacaaguuuccccuuuuaaauuaaaaagagagagaggaaaauaagugcgccugugugugugcgugcgcuuguguguacgugucugugugcguguaugagugagcgagcacgggcgcgcgcacaugcauguggggaggaucgugcugggguugucucacucacaguggguuccagggaucugauggaagugaggacugcuaaucagcuuccuuuuccugcugagccaccccacaggcaccuggcuuuucuuuuuuaaaaauccuuuggaaaaacauuagauugguuaaauguuuguauuaguuaagugaaacaagucuuugcauggguaugcucgugccugauuuuauuauuugcagagaaaggacaguuggcgcagguagaugaaggcuguuuaucugugacuguugcgaucgcuguugauuuuuacugcugcugcuguuaccucacuuguauaggaaacgucuuacucuguuaagaacguggcacauuauguuacuuuugcgaacccgcgccccuuucaguuuucuucagcuauuucuuuuauuugcguuuuucgagccucccgguuacagguccaauuggucuauauuaaauggugucugcucccugggucgcagugauucuucuugaguagacuucguugcuugauguccuuuuugccagacacagaaacuguaggaccugggcugcggauuuuuuuguguaguguugugacugaggaccuuggcgacacugggcucguucggguuguagcaugaacucugcacacaacccuuugugaccucggacugaaaccuucaguuuggaugguucauguagcaguuucucccacaggucagugaguaugucguacggcaucugggccagcguaggcagcugagugacaguaaccagguagcugugcgggugugcacucugcccugaaaaacagucaucaucuuuuauaaugauacagguucuaucagaaagucaucuuaagaaugaucucuguuuaaccauaugccccgcuuugcccucuugucucccuucagucugugggcccggcauugacauccgcaacgacuaucagcagcugaagcgccuggaaaacugcacggugaucgagggcuuccuccacauccugcucaucuccaaggccgaggacuaccgaagcuaccgcuuccccaagcucaccgucaucacugaguacuugcugcucuuccgagucgcuggccucgagagccugggagaccucuuccccaaccucacagucauccguggcuggaaacucuucuacaacuacgcacuggucaucuucgagaugaccaaucucaaggauauugggcuuuauaaucugaggaacauuacucggggggccaucaggauugagaagaacgccgaccucuguuaccucuccaccauagacuggucucucaucuuggaugcgguguccaauaacuacauuguggggaacaagcccccgaaggaauguggggaccuguguccagggacauuggaggagaagcccaugugugagaagaccaccaucaacaaugaguacaacuaccgcugcuggaccacaaaucgcugccagaaaaguaagagugggcagccgggggacuuccacuuucugcuccgugcuuucuuccucuuccucucccuccuccucuccuuugucuuugguggggcaggacgaaguucucucacaucuccacacugccuaguggaaguguuuccuggggauggggagggaugggucuuaucuagcuuuucugugaaucgggaucucucagaguacaggaccggagccuggauggaggcugcuguggcugcugucaagucugguuagaaauaauuugcugcaucuggaggcuacaaguuuacuaaccgucaacugcucugaugagauaggggacuuggugugcuuuguaagucucugauucucgacaaacaggcacuucuuacagcucagugccuguguccuuuguguaaagggauuuauaguaucaccacccaccaccaccaccaccaccaccaccaccaccaccaucauuuuguagagcaagauuccuucucacaaauaaaggaaacguguuaacacccguguccugagaaggugauccuuggcucucaggacccugaugcugcaggaaaucggguuuaauaugaaacacgugauagaucagaugccugcuugccagcuuccacgaguccuagguccauucucuacuuaaggcagcucuauaggagggaauguuucugagcccuuggguuuucauuccuuucucguacaccuguuguggcagucuugugcagacacuuagugaagagaacuuggaaagcaugcagugaccccagggucucauagugguguuuaaagcuuguuuguuuaccuguaauaugcauauguucuuuguagaaugccuaaacucauaccugaugugacauaggacaugaaaaucaacuuuuggcuaaaauguagcuauggcucagggcauuggcuguauugaauucaguaauugagcaauauuuagacguaguugccagcaagguuccccucacugguuucccucagcacguuagcuguuauuuuauggcuagaccaguuaaagacucaaugaguccauauaccugacuaguuaugaagauugccccauaaaucccgcacagaacccccagauggauaaauuugucuaaauucugaaguguguauaaucaacaaauggaagaccagcccucauggguagcuauuauuucaucaugccuggaguuggggccagaguaggucacacaccuugauguuuucugucauuugauuugugucugucuguggaauguguagggguaagguguaugcauuuguauguguggguguguauaagagauauuaguagggccaguauucuaauggcuaguacuuugaauagcugagugaaauauacuuuucugauugauuaaaaaacaauucccuaugcuuggcuuaauuaaugguuugaaaaaaaaaaacccuguaauucuuuuuguugguuuugagcuagggucucagucuguaguuggggcuagccuggacauguagcucaggcuacccuugaguucauggcacaucuccugccuuagcuucccaaguccugggauuauaggaaugaguucuuguccauugucauaaaauuuuguuuuuauuuauuuuuaaauuauuuauuuaucuaauauguuugaguacuuugucugcauguaugacugcucaccacguaugaguguagugucccuggaaagaccagaguuacagucaauuugugagcccugaagaugcuggaaaucaaaucuggguccucugggagagcagccaguacucuuaaggacugagcuacuucuccaguccccaacauuuuguuuuuaaaguagccuuggcauuugaaaaaaaauuaucuuaaaaagcaucaucagauuuggauacagaaacaagagugugugacgacuggacuggccagcuugccugagcuguggucgagcugguacuacggcagccacaccacucugucaugguggccaaacuaaguauggacaggaaaguguuucggaagcguagaagcucugcaugaaagggaugugcgguuugcagcaucauuagcuaacaccugucagcgaccccacagaugcucugcucucacuguggcuuuucagcagcuucugaagaagucaggggcagagauaaggccuguauucugggucagagucaagggccaguagccaggaacuaccaagcaauuuaaauguguaggguuuaguuuguucaucuucauaauggcauggauccugucuuccucauagaguccauggaagguuaaauuagaacaaagaaaacagccggccugaggccagagugccuguuggcuagaacuggucuucccaaggccguguucugcagccuuuuccuuggccgcuguaccaguccugaugacguguucugugguuucacaauggagugcuuaaaaucgcugacuccauucaagaauacugucuucuuaccuuguccugaaaacuuagucauggucacagcuuccuguagccuuucuaauucagcuagaaugcuuucccucuucguagacuccuauucuagucuaugcugucauguguguaguggcaccagucacacgugccugaguggagcacuugacccuuguggccugccccaagaaagcccugcuuugagcgaaggguuuccaggauguagucugggaagaaucuuugaaauauugccuacaugauuaaaaaaaaaauggauuccaugcucugaugaauauacucgaaaagguaaaacgugcuauuuauuaaaaucaguucauuugcuucucuuuacucgggaugaggccacuagaauguuuacaacacagauggcuggcauucucuuuccuuuggagagcggggccuuaguggcucucccuagacaacuggcuucugucgugcuguguucagccagagcccuccgucauccuucaaggauccagggcaagggcaucgagcccucacagaaugcccacuucagaguucacauacgccauucaaaaugaauauuugaggaaucccaguaaacuauuuacugcuggcugguggcagaggauugggaauaucagcaucuggagagaaaucccagugaagaauacgagugaagucaaugcuguaaaggagaccacuugaucaguuuaccccauaauguaucuucauucuucccgggucguaucuacuggcaguguggaggcagcccacuaacgaggggccacucuaccuguuacaaccucuguauuucuuuguuuuugugauuuuuaugcaggccugaguuguuccgaaagagugagggccccccccccccgaaaggaauuguguuggggaauuaauacgggaauaacugucagugcccucauguuugauggucgguccuugccuccugucuuguuugaaauggcuucugugucuccuccuucgccuguaguggcugcucuguuggccuuuucuccaucuaggcuuucauugucucuggccuuaauccaucugggcugcuacagcagaaugucacaagcuggauggcuuaugaacaauggauucacuucucuuaguucuggagaccagagacccaaggaaaggggcugacagguucucugucugaugaggaccugcuuucuggguucagagcccuccaccaccaucuuucauguggaaagggguaaggcauuuucuggugucucuuucacaagggcacuauuccacuugugagggcuccagccuccugagguaaggacaaagccucaccuuuuagcaccaugugcucagggacuagaucucgggauaggaguucuggaagacauaaucauucagaccaagacauggccacagacaggcucucccccuucuuccuacuucauuauauuuacugguuccuuagcauccucuugucuuuaucugacuuucaaauaccaucucaaguccaggccucuugcugagccuuuuuuuucccccuuuguguggcucuggcugucucauaacuggacuuguagaccagucuggccucaaacucagagauucuucugccucugccucccuagugcuggggaucaaggguguguaccaccacucccugacuucuauuugagcuuucaacuacaggugaagaccacccccauggaaugucuccuugcuucuaugguuucucuacauaacucuccuccccguggcggggguugggggggagggggucaaugcucuuguucuccuagcuaacgaucaucucagaagcaccaccacucgagccugcuuccuuucuaauaggccauccaagcccuuaccaucucaagaucugcuucacucugccguucucuacccuacccguugugaacacagugauacugcgcuucuccagccuccugcucuguguccucccacuucacuugucacccaugaaugucccaugccuugaguggcucuguuguucaccugcccuucuggaguagauccuuaaccaaggaguaggcuccuuggugccgcccccugcccccauuuuacugccccucacacuccugcaggcagcauccuugaccccccuuucccagucaucuuuguauuaaccagucugccuccuccaucucagaucugagacugaggugagcuccagccuugccuuucacgagacuccagggcuuuggagccuccacuaguccuaccuagcaccuggaaagguagguuuucuuuuuuucuuuuuucuuuuccuuuuaaacaguguucugugacuucuagcuguaucuaucuaugcacuccaggggugagcauggcaccuacuuugugaagauccacuuucccccaagcaaagaacaguaugcagugauaguccccagcaggcuuaaagaugguaagaucguaaaaugugguucugacccugucaccgucacugcuacugaggagcguguccuuccaaaccaucucuaguuccaaaauggcgggaagagcaccagaacuccccuucucaggaccaagaugcagaagucuaaaaaggcugggcuucuggccccagaagcuguucccuaggauguacacagcuggccuuguauuggaaggggcagcggugacaccuccugaguaccugugguuuucuggcuucucggugaauuuacggaaagugcugcuuugacacagaggcuuuucugguauuugauuucaugcgaggacaccuccuccaaaaaaacaaaacgacaucaaauaaaagguaacaaaaguaaagccugagaccucacugcuaaacuuggccucugagugccucuuggcucgccagaaucaacagcuugugacuggcucacagcaccccaucuagccuuugccagaaaauccacagagccgugagccuggcuacacuggaagccagcuuagcugccgggccagccuuacuccagauagaaagaccacuggcugagguaguggucaugcaagguauugcauuucccucuacccuaaaaaaaaccgaggaaccauggucauugcugauuggagcuucaggaugguccucugcucccuuuaucaacgggaaaacguuaccaucucuggauggguccagggacucaaaaugagggcaggugguguacaccagauaauucuggguuuuguucuuccccaugccguucuuaagucuuguuuaucaaacacuggucgucagggcagcacaggcggagagagaauugcuucccugucccugucccuuuguauuucuuugcaggcugguagaacauguccccuggggagaaaguggaaggguuuguugaagcaguuguaaauccccuggaguuuuugcccugugagaguccagccauguguuuggcaggauuuuacuuuaacuuuuaaucuucagcuaccugggaagacccagaguaugucuagaaaugcuguggagucuuccaccaagcugcuguagacugcuaaaagagaucaugauguagaccaugagacaggcccauggcccaugguggguaggcagacccagagcugaacaagaggccucuggcuuucgcauuguguuaagagcuugucuccauuccccgggaacgccucuguucuggucagcugcucccacugugggggugaucuuuauuuagaaggggucacaugcccugggccucggugcuauaugccuuuuauagccugguguggagauugcauucuauccugauugcgaaccccugguccugaggugcuaaagcaguuguuuguguucacguguuugugccaccgccuagugaucuguaguucuuagagcaauguauuuaguuccagaggggcuuugcuuugggcuggguggccuuugcugggcugucauucuucuggauccacuuuagaaguuagcuuuuuucucucuuucucucucucucuuuuaaaguauagaguagaguuuauucagggcaugggggaggggaguugagaggguaguagagacugaaaggcagggauggacagaggaagggagggggaggggccagccaugagcacguggagagaggcgggagaaggggcaacaaggggacaucuucauagugguuuuguuuugaacuugagguuucugaagaauacuauauauccccuucuaucucuuggcuacuuguagauugguucugaggaauacuauauauccccuucuaucucuuggcuacuuguagauugguucugguuucuuccuguuuccugauaacccccuucuuuguuugcauuucuguucuuaucuugcucuucucaugccaguguagcauccucaacuagaguaaggcuaacauagagcacaugggacuguggcuaaucucauucuggacugcacugcucgacucugguguaucgugguucaaaggucaaguucggccagugguggggucucuuuccagcacauggugugaaucagggauucagguuuaauaaggggggucucuucugagcucggcccuaugguagaauguuccccuuugacaaggagcagcaaggcaaggcuugucugccauccacaaaacagggauguucaggugguacccggaaagcccccagcacacugaccagcauugggugaauucuuggucaacagcagaagcugcugcuguuuuaaaaauagcugcauuuggagacccucuaaaauuuugagcauuaagcugaacuaacuguauauguacugcugucccuuaaguggucuuucucuguugccuuuccuaaauugcaaacauugaguuaucauaaauagcagggcauaguguacgagugguucuugcuaauuuaaucggaauuguucaaauuuucaugucugcccagauaagccauaucuuuaaagaacacucagugacguacauacgucuauccagaugccacuagagagaaaccuuauaggugucuguagacuccauuuguuaucagacucugaauuuauucugcuugcaagcuugguauuugggagaauuuaagaaauaccaacagauuuuuguuugacauugacauuaaacacuaucuuuugacucccccacccccaccccuucugagagcauuaaagugguuagagagugaguggguauagguuuuuaguaaagaaaacaaggaggcacguuuuuauuggugacaacugcagaucucacauacugaagguagcagccaucugcuccaggcuggagccucugccuauuuaugcuccucuuuggguaauaauagcuguguguauacacgucugugugcgcacaugcguuugcauuugcacguuugugugugaguguuccuucgggcauguguguuuaugcgugugugcauaugcagucagaccaccaccgucuuggcuuuuucacccggccuccucuccugcuuuguuauguuugguuguuuuguuuuguuuuguuuuguuuuguuuuguuuuuuucuucuccucucgcucauugcaggaaacaaacacuggcucucuguguccucucucagcucuuccuuccguuccaggggaucaggugggcgggagaaugcugugcaggaaugccaggcccucuuccggaagcagggcuucugguucuucucauucuugaacagaaguugcuuguugucccucugccuuggucacaaacaagcacucgguccucucuucuuccugucauuuguuuuuucccccauggggccacgugggauggcagcagagacagucaguguuuagugacuugguugcuugauacucagccuugguuagagacgcugucagacugacccuguauguagcugccucaaguuuaucuuugcaaauccugcugaauggaguagcuaggguugcacaguaguuuccccuacacauuccaugaccuccagcagaugacuaaagccauguguguauucacccuuccuuaggcuaugaagcuuaaaaguugggcaggaguagagauuagcuacaaugacagugugcuauaguuuauagcaguguaaugcaaugcaauugccaacaccacuacuccugcacuuagaagccguuguuaaauaagacaauguuuacuugagcaugaggcuaucaggaaggaggccccuaucccaaguugaugcaucuccuguuggcagcaggucuguggagucagguugcccaaauugggguuccucauagugcauaguuuucuuucagcagcugcggcugcaggguugcacuugguaguaaaagggcaaaagaucagcauacaaagagcauagcgcccccccccaaagagaagacuagaaaagggaagaugauugguccccccacaaacacuucugggcaguucuagcauuugaauuaggucuccuggugccccuacucucuggaaggauugugauaaggagacagguuggugaccagucagguccccgugacaaggaaaaccuagcucugcuccuggggcggugacuccauaggauguuuucucggauuucuuuuugacccccgaauggccuccuuauacuuugcugaguaaauguuaucagauaggauguagagaaaucuuuuuuguuccaucucucgguggguuugagauaauuggguuauucugugaugugucucuguucccuucagaagccucugaauaacgaaucggggaagcuucagagcagaagcagccagaaaguauccaguguugcuucccucacagacccgggaagggaagcgcagagcagaaacgcccagcgguagaccuccuugguagaccuccucacaguugcacagccuguccagggggccugaggggccuccuccucacaucagugcggauggaucuugcccucuucccccagcugauaccucuuccuagcuguccacuuuaugaacacagcagggcucuggccucgauggccauacggguuuaugaauggaauucugggaauguauacuuuucucugaagaauguuucuguagcgcaacaaacacuucuuguuugcugagggguggggggggggggagaaaucuuuccaaagagucacuggaugccagagauggcgacuaggggugggcuggagcucggggugaagcuguucacacugacaauggacaaaaagucagagccccuaaccuugccgaagaagucugucuugcaggauuaauuucacuguagguuuguugcuagcuauauagugacuauggcauuuggugcccaugcccuuaauaauacagggcuuauggguauucaguucuuagccugcgggucucugagccucaccugauugccuggcaugaguagguuucagaccuuggagguggcccaaucucacugggaggcuucugaacuucuuuggauaaaccaugacuugaucuugcugggcgcuguuacccuaagucuuggaaggccucagaguauagcaggguucuuagccugaggguugagaaccccuuagggggugaggaguugaauggccuuuucacaggggucaccucggcccaucggaaaauacaucuacuuacuauucagaacaguaaaguaauuccaguuaugaaguagcaucaaaacuaauuuuaugguuggggagucaccgcagcaugaggaacuguauuaaagggucccagcguuaggaagauugagaaccacuagauuauagggaaagggcugcagaagacgaguuccgucaguuauaaagaaaugguagucaggguuguacucagaccccacuucagcucacaaguuaaaggugaguggcucgugaguggcuucuuaagggcugcucggauucuguuagcaagcuugggguauagacaguuuuaaaaguagugcucuguuugcgagcucuucaacuccuguuauuacaguuuuguuugggauaauauauucaaaugaauacaaaccugaccuuccucugugccuucccauuuaagccagaugagaugcugagaugcugggaugaucagguaaaaagaggaaggcacaaggcagccucaggauccgggaguuuugcaugacaauagaaugugcagagucaggucgcaucuucccaacuuuugacuuacaaaggcugucacuuucccuccccccucuuuucuuaaccuuugacacagugaguccugcauuuucuuccaaccuugagauuuaaugucagggagggugguaggggucuaggguggaugugcuagcucuggggguuugacaaaugccgcuaagauugaugauagauauucuacccagccucuuuggauuauacccucuuguaaagaguuggcucuagauuggcuuuagaaguaggcugugaacucccauagguggcugaagcucccaaguucucaagaguauuuuuggagcuagaagcaggcuugaaggcuagcaaaauaccuccauaauggggcagaaauaaggagagauggucagagaaguugagagcaggaaauucagguaggauuuacauuuaagucuugcauuuuugaagugacauuuucuuggucuggcuuucgcuguuaugaaagugaauuauuuaugagcaccgaggagcaccaaugaaacuugauuauguggaaugaauuuaaagucagugaagucuuucuuuuagaccagugucagcugucccucaucuagcagcuugauaaccugggaagaguccaccggugauuauugcuguuuuccagagggcugcuuuugagagccaucagaguuggcagugcuguugaaaugguauagcacaggaaagucuuccuuguugguuugugaguugaguguauuuuguuauguguuuuucucauaggcaucuggguuugccaugcaggucugagccagagcaaacauugacugcugagguaguuuacgagaucgccccuuaucuguuguccaguccuugagugcuuacguccacaguguuccccagaucucccuugccaagggcucuuggagguugugcugggauagaucuggugaggaugugguuucugaaggucauuucuauccuuugucaguagguuaaaaagaccuuguccagucaucccuuaccucacucuacaaagaguuaauaaacagcuuauaacauauuuuuguuccuccugccucacagccaauggcuggccuguggaggagguauuauguggcccugaccaugugucccuuaccauauauaguguuuuagcaguuuguuauuaaugaagacaggaggcucagcaggagaugguggaggcugaggagagaaaagagguaagaccaggaugaggcacauagaacuuccuccuggcaguaugagagugagaacuuggguaacccaguguuuuaguuacuuuucuauuaccgugaagaggcaccaagacuaaggcaacuuacaaacaaaagaguuuauuggcauguaugcucucagagggugaauucaugaccaucauggaagggaacuuggcuugguagcaggcagguaggcauggcacuggagcaugagagcuuauaucuguucuacaagcaaaaggcagagagaaagagagcuauuccuaaaaaggcuccucccaccacacccagcaacauacuuccuucaacaaggccacgccuccuaauccuucccaaacaguuccaucaacuggggacuggccauucaaaauaggggccuguggggccauucucauucaaaccauuacaacuagacaguaaucuugucuuacuugccugcugguucugguagauagagaaacuuuaaggagggauuuauaaaguguuuucagauggcuaaaauuguccaugguuagcugggauaaauaggccaacuaaaugguagaguuuaugagugaaugugugucuuggguccuuggagguucgugcuccuugcuacccuugcagcucagugucauugaugaagcagagaagagguugauacuccuguggaugaggagaaagaugaagaggcuugaaucaugaggaauaucuaagcaggaucuucacuuuuuuuucccuuaguuggcugaaguuuccauucuucccccuguagcuaacuaauugagguagccuugcuuagugugaguuccauggcaagcaggaugagaggacacaagcuuacaauuuuguugggugauaaagauaaaaaugcaugaugcugggauggguggcagcuuacuagucaaaauguucgcuuuguaaguauuaggaccccaguuugacccccauuaaaaaagcgaguauggaguccccugcuuagagccacaguucugaggggcagagaggggguguuugggguuuuucugacuugccagacagccuagccuauguggugaaucacaggccaauaagauaccuuuucucggaaaacaugguggaggcacccgaagaacaacaucuggaguuguccucuggcuucuacagaguucccuccuuuccuuccucccucccucccucccuccgccuucaaaguauaaaaggaugacaacuuacauuguguggcaagguaaucccagcuuuggcugagagggaacuagagauacuaagugcuaagaacucagaggagggcaaguuuggucgguauuuggaguuuuguuuggaccagauauuugccuccgguaaagcugaggucuucccuuaagaaugcuugcaccggcucacuccuguuuacacggcuguauacacggcucucaauucaugaguagguugcacuucagauuuuaagauguuuggaaugugaaguaucugacauaaaagcagagguuuaguuggugauuuggaucccaggaucccuccaucugcuugggccccccgagccuguuuggcucguuuguaucugacuaguguccauagcuuuacuucugugaggauaaggcaaagcuuucuaugcccuauuucuguugggugaggcaggagcgguaggaaacugguuguuucauguuuauaccccuuacaauagccccuucugagagcuugacuuuuucccagauguugaggauuguaggaguggggcagcaggaaugcagggguuauggaagcuggaaaccaguacuccaggcucucugcucauucaguggggagaauucugaacagaaucagggauaucuccaccaacacuuaaguucgugaagguuaugcuggaagaaguguggacuuucagucuacagauggguucguuucugcucuacaugaaaggcugcugagaaaguugaaugauaguugaaaguuaguauaguguucagcagcauuugagucugaaaccacagggucuggauuacaaauguugcacaacuuuucuucugcaggcuugcuuuauggaguugucuguaaacacuauuccagaccaccccacccccugcauuugucuccucugcucucaaaucaaagagaaacucuuaguugugaucauuggccuggagaaauauuaaaucuauguuaaguaugcaggcaugaaugggcaaaggagggauuuguggaugagaaucugcugaaacuaacaagucauacauacagaugggcagagagagauuaaauugguugaucuuucggcuccugguacuuaaggcagagauaaaguagugagaaaggucguuguuugagcgaggaaaaaauggaggaguuugaagcgcugggcuuuuccugccuguugauagagauaguagacagaugaaagacugggacagccccauuuagaauagaguaugauccaggcugcucugagcuaauggaggaagcuggcauccucaggcuggaguuuauuggauaauagcucaguaaacuccagucagaagccuucuuuaacguuguggggagacuugcaguaucuacauuacgaaccuguucagauuuguuuuuuaagcaugcacacaaacuauuugcuuauuaaguggggcaguagaugagaacucagugcaguucuucuggcucgugguaugcccugaagaccaagaucucuugggauuucuauuaugauaguagugagaaaaaaaauuaauuagcaaguugaaaaacacccgagaagaguuuaggccagcgcacaguuaacuacuguacuguugauacuauuuugagagaauagagagaaugaagcagauuuacccuuuuuggggguauaggagaguuauccuucaagaugauaagaaaugugaauaaauauuuaaauucccagacaggaacaaacuacaacagguaacuugugacauuuaucugugcagauuaucccauaguguugccuauaaaucccaaaucuguaaauuuacaagggcuauugacugugugcgugcgugcgugcgugcaugcgugcuuggcagaggugcgaggccagccaccuaacacuugccuacacaacuuuuccucauuuauguguaggaaaucuuuuuuuguagaccacagaguggauuuacagaggggagaaugaccacagaguugaggggccguuuccgacguaggguggacugacgcaggagaguacaguugauguggaugaugccaggauggcaucgguuuuggugagugagaagcagccucugauugcuugccugguacuucuuuaguucaggaauccuuucuccacuggccuuagcaagugcccucuuguucgugcuuauguggccuaagguaagcgccgugaccuuuucuuaccuagaacuuuauuuccugaugaguggaggccccagucucucucuuccuuaggccuacagguaugcgcaggugaguugggucugcuagcucccgcuuugguaaauaggagaugaugcuuccuccugugggguccauggccugggguaaagugaagacauuuugugggcagagagaagacaagaggaggugcacacugugccuuccuccuaccauucacagcaggguccuucaaaccucuuccguaucugcagauuugguaauucaaggacguguugccauuggcacaguggaaaaggcagccccuggaguugaguucagugauagagucuguguuccacagcacuuucugggaaauagcuucauguguccccuucauccccagaagagucauaggaagccagaaaggacgcuggcucggauagagccaccucccguguaccagagaaccugaacacucgcggcugcugccuucaguucaccugccucagcuguccuuaacccugucaagcgcucugcucugaagcggagauggagcagccgaguaagccuuacugacacacugacccgacgguccagacaauacacagggucuccucagaucaggaucuuuguccccuuuuucaagaucuuugcauacuccacugcuuuuugaaaagaagaggugagauucacuucuaaaucugggggcuaauuugagggcuacuauuugugaagaaagauguucagaaccuuugcagagauuccuccugccuuuggagguuucccaaguuagucucccagauuucugcaaccugagcaaugaacugcauauccaaaaacuuccugggucuugucccuguugaccuaaccccccacacauguggacagcagggugugggucccagaauguggaaacgguugcaugagucugcacagcuggauggcuccaguucugccuuugaacaccuguguuaacucucuaggaaaggacugugucuaaugacuggaguggcaucuuuugagcaauggccagguucuacacagcucaagaguuuuuuuuuccucugaucucuauacugccugccauaguuugcuuucuauuuuuguacccaagcaauagcgacaucacaaggaaagcauuuauuuuggugauaugucccaaacgcagcacuucaugaagggaagccgaggcaggaacucaauccugagggugggaacugaagcugaagcuguagagggaugcugcuugcuggcuuauucaaccugcuuucuuauaucacccaggaccgccuugcucaggggcggaccccaccccagcaaucugggucucucuguauuaaucauuaaucaagaaaaugcuccacaagccaaucugauggcagcaguucuuccacagagauuuccccuuucucaguuacgucuggguuuauguccaguugacagaaaaccaaccagcacacugccaauucccuccauggccaggaaacugaagcacagaguccuggcauaaguuaugcaagguaccuugcagcuagcuaagucucuagcccugcccucuugugggaaugacuuuaauggccucucuugcuuggcagaaggcugaggcccugcugggugaauucuuaaggaugauuaggcuuguauauuuguauaucuuauguggcagggaaucuccauagugauuaauaaauacagucagaguucuguuggcagguguccuccugcuugccccuccuccuuuaccuguagguccaccuucucuuccuucucuccaucucucuacccuuccucaucuaaugucccuccaugccuuccuuccuugccacuggucaccugucucuccuugucccccuuccucacgaaugaccugagcaucguuaguuauggcugcuuagucgcacggcagcguggcucugaguuguaagaccuugcuugccuuugucugacuccucuuccccaagcacuauugauuuuuguuuuuaaacauagauucauuauuuuuauuugggaggcaaaacuuugauguugaucauugaucaagcaccuuuguuuggcugauuauuuuaacuggggagacuuuauuuucaaacuauucuuuaauuguaaggaaauggauguuccggcucugaugaauggcagguugugguagaggaagaaagggaugugguuuacaguaaacuuucuaucuuuuuaucuaucacucaucacagauaguaaaauauauaaagccucaggauguaauuuaucaaagcagacccuggacugcagguuuccacccugaauugggcuccggaacagugacugaggucggugguaugagcuggcguuuacuuucuugccuuuuacuugugaaagcugaccuccagguugccgacucagacccaccaacauuuacugggugucuuuucaagaguuacagagguauauguauaacuuggcuuucugaccuguugugaaauaaggcccaaguauggacccagaugcuauugcagagccuuguacuccugggugucaccugagcacagaugggcucuucuccuaaccaccaugucccugauucccacauacaaggacugaagaguguagguuucuucaugacuagggccugggcagugagggcccucccugccuguccugugucugccuguccuccgggugggucuagcacugacuggaauuccuguggacuuagucaccaagcugcagugguuggaggacagggaaaccgcugggugcucugucaccccaaaagaaugcaggcugggccagggcugccuggcccagaaaguucucuaggcccuguggcagauccaucauagcugacucaaaacuaccucucuuuuugucuuuuuccuaucaaaggagggugggggaggcaggagauaggagcagagguggccucuuuauucacuggggaggacuuuaaaaacucacuuuaaacuguauuucuguucuucaccuuuccagaccuguaaacacacaguuacuccagguagguauuuuaccaagagcuuauguuugaggagaaauccugccgguguggcugucuucacuggaugcuuuuguuugucuguaggaggcuggcuggcagggugaggugggagugucaggucaccuuaaguucuucuuguacuguagacccacauguagcgaccuuaaaacggggcugggguuggccgccuuccugcugcuucuagugagcgggucuggcuuggugcuggguuggucucaguugccucucauggugccugcugauagaucagugaucaacgguagacuuccagggacagagcccaggcaggaguuagugaugggggaugcucugccacagcucuuuaaaucugacccagagcagacaucugugcugcugcuccucggagccaucggcagagucagcccugggcucugccagcuccuaagcauuggccagcacgguuuuaaucuacaguuuuuagaugacaucuuuuucuccggugggucugucaggcggcagcaaaauucucaugguaggaaucagaucuaacuuaacauuuugagcaacagaacugaccuguggaagauucacuaggugucuaacucuagauacccucucccuucccuuugaaaagaacugugaguaggcaagacuggccugagaacguugcugaaaugggggcaguucuucagcgaauagcugugacacuauuauacauuaaagaauaaaauccccacauuuuauucuauucuuuaaaaaggaauacacuagauuggcaguucacauggugaccucuucaagggucaaaugggucuuucacaggggucacccaagaccauugggaagcacagauauuuacauuacaguuccuaacaguagcaaaaguacaguuguggaguagcaagaaaaauaauucuaugguugggggcuaccacaacauaaggaacuguauuaaagggucacagcauuaggaagguugagaacugucgagaaccacugcaccagauagagaaaaguagggcaguuuggguuucuuucagguguguaugguuccaaagaacaaguuucuuaacuauacaacucuucuugcuuuccaaguuaaaucugaugaggggcugaugagaugaggucugaagagaugacucagugguuaagagaagcuacugaucuuguggaggccccacagucuauccccagaccucuugaggcagcucacgacugcuguaacuccagcucuaggggaccuaagcuaucagagggcagcagcacucaggugcacaugccuacacauagacacauaaaauaaauguaaaaacgagaucucuguauacuucuguaaauuaagugaaaaagaucccaaacggcacagucucugaauuaucaggugucagcuggcguacucauuagaagcuugccagaagagauccuaaaacauagucucuaccuucuguagcaaggagcugcaaucacaggguggugaccuuccccguccaucucguauuuucuuggcagaguuuauguuuuuaacccgugugcuuuuaacuuuuuuuuguagguccagagguguuaucuggaaaagugggcuucuggcccuguuuguguucauccuguuucuuugcaccgagagaagcccaaacacauacacaaagcugaacucaaaccuuccuauuguuuuucccuagaggacauccccacuuucagcuucacuucagggagcacagacuguguguggucuuagugaccucucagcucccuggagacaguagcuagggucuccuugacuuagcugggcuuucucaggcauucacgccugggugggagucacuuucuucuagaggaacccaaacaguaggccuuggcagaguguccuugagacaguaugugugagccugugugucuucccuuagaaguaugugugacuggccuugaaaaugcugugggcuuugaaugagguuucccugggaagacauggcucucgguuguaacaccgugucugcagguccgugauccugcaauuaagggacaccauggcuucauuuucagggcaucugguuuaaaggcacaguuaaaagaauuuguguuggugguucccuuaauuucuaaaauacggcugucuguggcuucauccaucuggauacuuguauugaguauuuuauugccacauagaaagaagguuuaaacacgaggaggacucacucacuucuccugucugaacagaucguugauaccauguagcuucaccacacuaguucaucucucuugaaaacaagacaucauaguuuauugguauuauuuuuuuuuuuaccagccccaaaguaagaccaagauuuacaucagagacaaauaacuguauaauaguuauaauaacaaauaacuguaaagcgggaacggguguuuccagaacacuugguacuuggcgcagcacuuaccuguaguucccagguugugccccaguguuuucuuccucugcuuuaaugaucauaggagcugcuuuggugaucuucgagacgugccaguggaacuguuuaggaagcacuuugccaaggcccuucccagcucugaugcagucucuuggcugaggaccagguucucauacccagggcggugaccuuccaggucacccucuuguuugcuuaugaaaaugaggcucccagggaauuaauuguuucuuccuggcuaccuccagaggacugggaggaauguuagaauucuaguauagauucccagugggacuuuauaguuuauuguuugcucaccuuaaaaaaaaaaaaaaaagagaucuacuggguuuuggauaauuuauauaaauggcuuguaaaaugauuaaaagucagcaauugaagaaacaaaaaacaauggcuaauuuuuaaaucuuuuuuuaugcuuucaauacauuuugagaugacauugcagugacauuacugauaaauuauuuguguaugguagcaugauauuugcacgcucauuguguaccguggcuucuguucauucacgcuuguagguagcugugcuaagagcuagcagagcuuugguaggaaucauuagauguauuuugaaacuaacucgcucuguuaccagauucaaacuguuguggacgggugcuugguaacucugauggccauuuugaaguguuaccauagugauaauucuucuggaaucuccagucauuaaaagugauauggguagcucuuggcucuguguuguaaaaauagauggcauggguuauguguaucuuuguuuuuuuccaaugcuauagcucauaauaacugaagggacauuuaguugcguugugcauacuuauuaggggcuaguugucuggccauauaaaucaucuguccguguaauaauuaaccucuaagaaugaauggcauuuaaagcacgauucaauuuuccccucauuugacuuugguuauucuguucuguguucuuuucccaggacauuuuucaaagguugggauugacagauuaaucaucauugauauugcucccauggguuuacugagagagugucuagagcuccuccacucuguggccagauguggaguuucuuaugcacaugggaagugccuucuggggagcacugguuguuggcucagucugugucccccuucccugaagguaacuguggauauguuagaggacagugccuccuuucagcccaggacugcuucucuuacuucugaagcccaggguaguaauuaaagguaucuguguucucucccugguuagaggcaucuaaguugcagacugguaaauagggguggcccaguugguccaggguuugaaugaaaacguugggaaguaugguuggaugguuggcagugacacugagcaguguguuugccgacggcagggauuuugguucuacuuguugacuagaaucacaugccugggggaagcccagcuuuacuuagcgaagggauugcgugugagcagucauguuccucccagucuccccaccuccuucacuggguccucugcgugcugcaucuguuucucacaaacguuugcugguuggcaggcguggaugaaagcacagcccuuacuugugacaaacacccuugucucaagguccgugguacuguaauuagaaauucaugugcucacaggggccgagcacuauacuuggcucugugagccugaauaagaguagagaguucugcuggggauuccuggccugguggggaggcugagaggugaacaaaugguacugcccugugcuccuuuuaaugcaagaacagccggcccagaaaggccuggagaagggacagguugguguggagagggcacacucaggagcaggaucucaaagucugcagaguuuucgggggaucgagggaugggaagugauggagaugaguggacaaagagagaauguaaggucaggcauuguggacagauacuggugagggugagugugggauugcugguggaaacugccuaugugccugccugcacucggaagccgggccuuacuuuccagacagggacugagaagcaggggagcgccugccgcagcauaucuguguucuacaaccauucugggauagucacccaaggaaggacaggaagcagcacuuccaguauguaagugagcugggauaaguauagaaaaagauagaugggagaugguggugaaugaaaggaugggagggaagaaaaucaaggagccaguggauggaugacuaagcaccaacaggaagaaaugggcugaccaucgguguggugcuguuaacugggauugcaaaaaggcagagauagaacggagcaggagacaaaaagagcaacugauggugcguuguuuggggaucuucugugugugcaggcugagcugguguggaaacacagaccugggagaggagggaaggacacuuuagacacucgacuuggagcccaccucagugacaucuccaggggauauuagcuuucugcuccugucuuagucccucuucuguugcugugaagagaugccaugaccaaggcagcuuauaauagaaagcauuuaauugaaugcuugcuuacaguuuccagaaaguuaguccaugaucauccuggugagaauagcacaggcacaacacuggagauggagcagagagcucacauucuuauucaaaggcaggcggcagagagaggcugagaccaggccuggcaugggcuuuugaaacuucagauacuaccuccuccaauaauaccacaccuccuaagccuucccagauaguuccaccaacuagggaccaaacguucagcuaacaaccuauggggcccauucucauucaagccaaaaugguucccguaacaaauacuugaggaaaaaucaacuuguaaauagaaggccuuugcuuuggcucacaauugugggcguuuggguuaguggcuagggaacacaaguguuuuggacccauggaagggaagcacaacaccguggagugcccggggaggcagugcucaugacuuuauggccaaagagcgugauucugccaucccuucacagguacaucucagugaccugaagaccucauacuagauagaucauacguuucaaaauuuccaaucuccauggccagaauccauugugcuucauccaaaggcagaaaagggggguguuguuaggcuuggggaagagggaacacgggaggggaagggggaggggaagggggaggaggaggggaggaggagggggaggaggaggaggaggcgaacgaugacgaccaccaccacuaccaccaccaccaccaccaccacacucaggcagagaaaucuuucuuugggagccuguaaugcccuugcccauccuucuggagugucuuuugagggcuagauccuccccaaacccuuaggauuucucugguaaacgcaaucugaacauugggaauucaagcauaccacccccgacuccccacccuguaaggcaggaugugaggaacucaugcuucccgaaaucacugugauggggaccucaaacaaucuacccaaaguugccguugagaggcacagucuagggguugguccuauuuauacucugucuucucuucccuuuacuuauugucaaguccuggguccagauaauguuaauuugaucugcuaacaagcagggucagaacugggguugauacugcacucaggggaaguccucacaaacacaccgcagcggcaacagaagugugcauaucagcaguuaacaugagcccaccccauggggcccucagacaucggcugucaguagguuucaguguuuagauucaggaagcagugcaucaaauucacacuaacuaugcuacugcuucugucaugagcauuaguccugaugggauuuuuuuuuucucuguaaagguuuccugcaaugggaagaacacuuggguuuugugacugagcgcgaugguaucaggcguuccccauuuggucauuuugcucagauauguuagccuaaaguuggaggguuugccacauuuuuauucugccuuuaacuuuuuuuuuucccgagucucaggcauaagcaaggcaucuuuuuaaacaucaaagcagcucagcauugagucucguuauuuuccuuugugcuuuuuccccucuccuucauauggaagaagcacaaugagaaaauguaguauguccaauagggcaugugaacuuacaucucuaaagauacauaaagugacauuaauuuaacaguaaagucaccaaccccaaaccuaugucacuucaggcuuagucagaugcuaacagugauuuaaaacgaagaggggacuugguagauacacgccucuuguggauuaaccggggacucuuacucugaaccuuaacugcccuuuguaucuauccaaggguccagaaggucccuugaggaccuagaagggccuugauuggugggaaguaaagcguguauuggcuccuucugggucaugacaacuuuagggagccagaacauuguuuucuuagugcaguuuugccuuuuuaaaagucguuuuuaauucuguauuucccuuuaaggcagaaacaaguguauagggugaaaauuuucuacaaccugucuguaaaccugaguuugcugcugcccuucaccgcugccccugaaaguagguucugaggacuucgaauggcagguuugauugguuguagcagguguucaccuuggguuucagagacuagggagcuguucacugaaauguccccaugcauacgcacccuccugcaccaugagaaguagcugccccaagucucaucuacuccugcaaguccaaguaggguuuugcaggcccguuggacguguguugcaugaagaaaacucauugguuuaugugacaauaacauugggucucguaacggcagagucucaggacaguccucaggugagucagggguucuccaugguccugccugccugucuguguguuggcuucauuucuaggguccaugugggagcaaaagguucacuggcucugucuugugccuccuuuaacauaggaugcaguaccaaaaagcaagggcucuguucugauggcagaagcaauuuucuaggucuugcucuguggccauucuuuccacccauguguucuagagaugggcuggcgcaggccauggggucccgggacucagagaggggaaaaggacaaaaugguucucuugaggaaaccugggguucugaacaaggugaagaggauugccagguuuaaaaacaaaaaccaacaaaacccacccaucuuacauagcugggccacucagggugugagaauuccacuuuggauauaaagacgcacguugagaguuugauuucucuuagugacgcuguguuagagaaugagagacuuacacguguaccuggaaauaggcgcucccaggacccgugugcagcuuguagcuucccucucucucuacucugcagugcccucugcccuggaagcaggucuguauugucacagugguauugagcaggcauaucaaauuaaaaacuuuugggaucacucaccaaaacaguuuccuguacagcacucccccgagggggcauggcaguaguuagacauccauuucauugaucuauuguuuuuauuaaaagaagaagaagaagaaggaggaaaaaaaaaaccccuucaaccaagggaggaaguacagccagcugccugaggaacagacaagaucggagaugauguuuugauuacauuaauccguauccuguucauucacuuugcuucugucgccgcugcuggugaaguuacuaaugugaacuaauuacauuugcucugaaaagccagaguuuuuaaugcaucucagcaagaaagguuaauauuaucaauuuaacagcaugaaugaagcauuguguguguugaacuugaacuguccuaaaagcuugcagaauaaaaaacaagucucucugauaacucacuggauaaacagcuguggcugagaucugggcagugcguucgucucaucuuuaagguguauggagaugguaacugguuaauauugggugcaagagaacuucgaggguuuucccgauugauggaggcauuuuaaagagaguggcccaccgcaccccacccuuugaugcuaacaggcguccgguuuuccaaagaauaugcaguuuacagcagagaugcuuuaaaagucagucauuucucuggcacaaacccagugccugaagaagguguuuugaaaagcaaagugugccgggagagccgccuugucuacagggacugaaaucgcccuguucccuugcccuugcacaugguaccucaacgaucccugacguuuaauuauuuccugcuuuugugugacucacucggcagcacacaaugaggacagaacagccugccauccgcccugccaucccugucuugggaaccacagugcuggcucugucuggucuguacccagcagggugcugaaguguuugaccagugacauuucaguggccaguugguuccucggugucuuucacuguagggauuagggacugacaggggacuuggaacuuugcaugcauucugccugggacagcgugucucuugccuugagaguagaggaguaaguugauaggagauuccugggugggaucuauccaagagggugggcugagucccagcacucugcuuggaaucugaugaugaaucacgugggguccuaugccugaaaaagucucgugccacggcugcucuuaaaggguauugagagggaacgucaaauugacaacucaaguuuauucaagauugggaguguucaauuuuaaaaaguuaccucguuccucccuuuuaacuccucacuccgcuuuagaaugaagaaaaguagcuuuuagaaugacaccgccggccccaauagcccagccucuggagaucuaaggggcugaagugggcagaaagaaggcaggagcagacuugcaggagguauggguagaaggggucaggaaguucuguggcuuauucaguguuccaugucaacccuucaggcuugugccaccgaccuguguugacagggaaggaucagugugugccuuugacgucugucauaaaaggaacaguuccuguccucucuggaguuucugcuccuuuguuuaugaagaccugucacuccuauuuggaugaugaucuacgcaguugucacagugcugggucaugcucucguguauggaacaaagucccaugacaguuggucaguucccaucuaaauaugucagggaacccuaugauagaaguuguggaggcaguacagcuguuccuuuaccuagguaacacaguuugucccaaaguuugaucccuuuguguacuaguaaggguuuucuguugucauagaacuuacggaaugucuaucuauauauuaagggaauuuauuguaaugauuuauggucuguaguccaacuaccccaacaaugggcagcugugaaugggaagacuaugaaucuaguaguugcucaguuccacgaggcuaguuguuuuaagaacuucuguagaaguagguuccaacagaugugcuggcaguuaaguuuaagcagucaaagaagagugaaucuuccuucuuccaauguccuuacauaagccuccagcagaagguguggcccagauuaaagguguguaccauguaccaucaugccuggaucuaggacuugcucugucucaggcugaccuuguucucagagaucuccuuaccucagucuccugagauuacaaguguauacuccugugcccgggccugagcuuuucauggccacuaugccucaagaucuccaugucaagaucugggucagaagccugugucuuccaucuuuaagaucuggaucacagaugccccccucuauuucuggauuuguaguuccuuccagauguagucaaauugacaacuaggaauagccaucacaacuuuguaaagucagcugauggucuccugacugaguaggggacagagugaccagugagucugguacucuguucagauguaugcuguuccauugcaaaucgagcuugcuggaugguggggagauaccauacugacagacaucaugagggugagaacuacuggucuacaggucucuucaggaaugagugaguuggcagauucccccaaagaauauucguccugagaugcauacuguuagguaugucuaucucuacuuuauagacauuguuguccccugccucuuccagaauuuuugugaauaaacccaacauucauaaucggauggauuuacccauuaaaguuauaaaagaccagauuaacuggaaauucaacauuguccaccguaccuaaccuugagcgucuucuugaagcucaucccacaguguacagugauuuccccagacuccuugccuggucuuuuccacagccugucugguaugugugaugaaccccagugccuggugaagaccaugccucagagcccucagugaagcuuucucagccucuaaaauggccaugcucgaguccccaugccuucccaacguguuacauacggagacgcaaagaugugaagggaaaugaggaccgaacccagagucuaagguauaaaguacauuuccccacaaauugucguuuauguuauuuguaaaaacaaacaaacaaaaaacaguuguaacauucuucauggaucucaaaaguuaacuucaguuaaugcuuuauucacaacugugccacacauccaagaaaaugguggcagcccaugacccacaggucuucccuggucuccagugagggucugaucugagggacuucguugcuugcuucuguagugcagccuucguaggcaugaggcauagaucaauuuuuuuuuaauuuccuucaaagugacacuuuugcaauuuuucauagcugaagcuuaacuggguauuuauucuaaacagaauggcaaaugauuagacauuauguuuucugguaccaaauagaagauccuugguggcuaauuugucuuuuaaaucuguaucauacauaugauguguguaugaaauagaagauggucuguggaaaaugauacuuuagcuaaaagaaaauauuaaccuuagaacaagaaaucuaaucugcucacucacaggagugccgugccugugccuggauucugcuuagcgccucugcuuugaugaaggacaaggccucacaguacugugaagaauccuggcuguggaagacagcccaagccugggcauuauuuuuuacugaaaacaauuuugacucauauuauuuacuuuagagacuaaaagaaguauggccaaagcuuuggguuaauaauccugaugauguaaaauaccuuagcauuccugucucgcuuuugcuuggcaugugguuuugccccaguuuuacacacccgugugugcacacgucaauucaccccuacacucaagggcuuauuaaugccuuuuuugcacucuuucuuuuggagaaugucauggccaugguuaauaagaugacgaaugggaccaagaagaaaagcaagcuagagaagcauuuaacaaacagguuaagggucugagucguuugagaagacggaaacaaaacaaaacaaaacaccaauaaacaggaagccaaaacaaagguaaaaagagcucgccugcugaaagcugaguuaggcauuugcagucaccaugcugacgagcuaugguggaggcugagaggguuuugugguuaguugugugugacacagaaaucgaugugccugagagccuugggauuucaacucuggaggauaaaaguucaacagagggaagugugcuguauacaauuaagauguggcaugcugugucugcuggguaaagaugggauuagcuguguucugaaggcaggagaaagguggcuaguaaaauggcugcccuggaggcuagugugccagcugcuucugcaaaggcauguggagcagacuagaaaaccagagcacucuguccaggaagcacuuuuccccacuccccgccauucucugcagucuccuccccuacugucuguuaggguucagcucucaaaggagauugagugaaacuuaauuauguuggagaacccaguuugcuugaaguauuguauuccaggagaggguccuauuggcuggcaaaucuuacuugaauauauuugugguccuuaaaaaacaaucaugggggcuggagagauggcucggcaauuaagagcacugacugcucuuccgaaaguccugaguucaaaucccagcaaccacauaguggcucacagccaucuguaaugaaaucggaugcccucuucuggugugucagaagacagcuacaguguacuuacauaauaaauaaauaaaucuuaaaaaaaaaaaaaccagucacggauagaaauaacaaagaaugguacuuaauaauauuuuauguuauaaaaacauuuuacacuuugauaacuuaguucuaaccuguagguaagagguaaggucuugcuguugcccugcaugguaagguuguugcucgugauaacucgucaucugccauucuaaugcuccauaacaaagggaggauuguaggaauccuuuaccaugacaacaugaucuacucuugagauaaacaagcuuuccauagguugagcauggcacaguauagcuacauauuaaaaucccacacaaggcuggguauggcagcacaugccucuagucccagcacccugcuuguggaaauagaagcccacaccauuaaggccagccugggcuacagaaaacaagaguaaaauagauacaaaaauaguauucacaugauacuucauaaaccuugaguuccauuuuucaaaaguauacuucguagauuucaguggaauuugacauuccuaaacucuguagauuaucucuuuuaggugaguuauuaccaaaaacuccuguggucaugcugauuuuccuugccauuaagcugucaccauuguaaaucuugggauguagcuucacuguccuuucccugggcauuuuugauggcuauuucugguugucaacuugacuacauuuggaauggacuggagaaaacccaaaccaacccuccacccugaaagaaagaaaaaaagaaaaaaagaaaggaaggaaggaauggaauaaagaaagaagaaagaaaaccaccaauaacacccccucgucucucaguuuuuaacauuuccugaaacugccaggacacuguauguggaagugacuuucuuccaggguagaguaaguugcuucucacaugaacacugugccauucagucaugcacacugccauucaguuggcaccuguuuuugcugcuugcuuaagaaagaaaggaagaaaggaaggaaggaaggaaggaaggaaggaaggaagaaagaaagaaagaaagaaagaaagaaagaaagaaagaaagaaagaaagaaagaaagaaagaaagaaagcgcgcucuguauguccucccccccccccccgcagguauccagagggccauguugaaaaacugccccucccccagcauuaguggcagagacuuugggagagcaaagggucacaggugugccuggccuucugguccuuuguaucuccagauauaaagauggcugaagguuguagauuuuucucaggacagaugugaagauugauccagaaaaaaaagcaagagacaggaaggacggcucagaggguaaaggcgguugccaccaagcacccaaggaaacacauuaugucaaucaugauuccauaauuaauggguuauuuuuaguuuuuuaaaaaacuccuguucuuccaaugaccacauccugacuuuugaaaacagaacaaauuagauggauuuaagagagagagagagagagagagagagagagagagagagagggagggagggagagagaacucaaaaaaaaaaaaccauuuguuuuugaugugauuuagaaacguaaacacaagaaggcacguuuccaugacacugauacaucaucagguuauuacagugugcuuuugaggucacuggaauuaucuuguccuuuagaguagugcuggcuuggugauucauucauguccucuuauuggccuguucauccuggcaguccgauaaaagccagccuuccucaaggacuugcaagaaaugggucuuguguccacaaaaggagucucuuacuugcuuccagcagaagggacacaacuccaaguguucagggggcucuguggaguccucaugagcgugcagggggcauggcaaagagacugcacacacaugacugcuccguuuuuaggguaaaauuguuuuuuauuuugguuuuuguggauaagagagauacuaucuagagucaucuugaagagucaucuugggggagagagagagguagagacagagacagacaagacauggccagggcuaucuacuagagagacaugacagcaagacacaacaguggucacagugagauaguaagagagaguuggggcaggaacaaaacucggccuugcucuugcauagagaacaaagugguaucuggaaggagggaaggcuggggagguaaaaagggccagcauguuaguguggugacuuugagauaaacaacaaaugcuugcagguaggaaccaagggagccuggaggccagcguaggcuuuauucugcaaccacagguauaugucaucggagagccguucccuucugcuguacgcaaguacgugacucuguuggggucagaaaccccauuuguuacaaguucuugagguaggcuggcuuuuaucugucugccagaaauccuucuauaguccagcuugggcucauuucuaggaauaugggcugccugcaaccuaacauugaguggaacuuaauuauguuggagaauccaguuugcuggagguauuguauuccaggaaagacaaguguuauuaagacaucuuuuaucaaaccagccacacauuaacaggacauugcuggagguaguguaagauccagcagaaaaggaaaugucuguagaggaccuguaaugggagagaacaauuggggccacauaggaucccggaaaccacgaugaggguuuuguguuaacaguaggaacaacuagaaauugggagacugauguagaauaguaaggugaugugguacauggggugaguaugggggugggggagcaugguauuugcauaaaacaaucacucuggccaucacaugaacaauugugggguggccacuauuagaacuuccucggaguagacaagguagagggugauguuaccauggauacaugguggagagucagaugacuaacuguagggaggucaaguuaaacaggccucucagaggugauggggugucauggguaauguccagguccaagcacgugugaagccucugucacugcccaccccuaagaaugagugaggagagucagcauggagucaagaaaacaucagugcucagagggcagugguccacgugguggugugugaaagcagaaacacaggugaaaagaugaaggagccuuggagcggaaggaguggcgucuuuuaauggcuggggagaggaaaaugaguuguaaaggagccacaagugaaggccauaaaguguugagucaagaguagagaggaggcaguccgugcccacaaccaaauggaaagagaaauggggaucucugcaggaugccuuggagggccagaccugagauccaguggguauagugauggggacagauguggcccuggaauggaagaggaugggggcugaggagcuguaggcaggaagcaaaacacagcugggccugggcugugcagaagcccagaauggagcauggcaagacaugcagggaggauucgaaccccaggguggaccaaagcacagagacaaccauuagcuuucaguaagagaagggacagauaguccuuuaaaggccauagcaaugaaacuaagcugcuuuuuaaaaaaaauuagagaugggacauuuccuaugaaugaccuguauauuuuucucauuucuaugaguaaaagccaccgaucucuugguuuuguacagugggacauagaaccuuagagaagcuaggaaaucugccggggccugcaucagggcuugagacguggauguuuucugcacgcaccgucucugcucacugcuggcauugcagcauuggccuguacugugaccaggagggccgagaguaacagucugacgguuuuagcacaaucauaucuuaacacaaacuuaaugcucuuuacguuuuauguuaauacccuuuuuccuagugauauuagcuagauaggaggaugaggugaaguguuccucagguaaagcaagaaaaucuguacugauuugcuuggcuaagcccuccacgugaauuucuacagaaaucacgugaguuaauuuuugugugaccacacugcgucacuagguacucuuaacuggagcugaggacuugucagcaugaccccaugugauccgaucccucuaaugaccccagucggucgguugguucgugauuagugaguguuagaugaagggcagugcugagucagggcucccacacuucugagccauuuucccuuggauucccucugccagcuugcuuuucuucucacuucacaugagaaagggcgaugggacuggcuaaggccagguccugaaaguagggagcagcuauuaugguguccugagaauuaaggaccugcccaccccucuuggaagaacugcaggugcugcguaaagaugguagacugaaacuacuggcaguguuaacucaucugcgagaaacguuuucauguuuugauucugacucauggcuccagcugcauauguagcagaggauggccuaguugcuuaucaaugggaagagaggcccuugguccugugagggcucuaugucccaauguagcggaaugccagggccaggaagugggaguggguggguuggggagcggggugggggggggaggauaaaaauuaaugaaaagauuaaaaaaaaaaaaaaagaacaggcuguguucucaggauuuugaggaagcaagaacuccagugcauugcugugaacgguauaaaaugguucagcccucacagagggcaaauuggaccaaucauggccauuuauaauuguauaugaccuuccacacggagguggcacuuggggagauuuaucuuagggacacaccugcuuggguauggacugcaguauugucuguggugguaacccuuuagaagcagcccacuuguccuccagcagcagcagcagcagcagcagcaggagggugcugguuaaugcaagaagauaaguacauggagugaaaugucuacugcaccucaaaaaagccuaaggacacccugcuccuggucugaauagauccccaggauacuaagcagaaaagccgaggugugcuuuguaaauuugaagaagagacaaggcugcuuacauuuugguuguauuuguguagacgccaagaaaaugauauacaccguguagcacacaggguagguggggagcaaauuuagaugagagccaggaugaggcuuuauguucaucuuuguauuguuuuuaagaccuccauguaguaaacguagcugcuaggcuauguccugguuagguacgggggcuuuggaaugugccauagguugguacgagacgguuuccuagcaggcugggugcagugagaacaaacagcucuugaguagauuucuuuuuuuacggaggguguuuuuucucucauccacauacgagccaggccuggugcugcuuagcucccuaggugagacgagaccuggcacguuuacggugguauggcuggaguagacugcaggguguuucccccaaaaagcaccugucagcccugacucuaccucaugcucuacagucgugcgugcguccguguagagggcagggagcauuuccagacagggugccuuucccauuuccuugucagucauaggcuuaagaauuaaacaugcccuuaggaguuuauaagaacuugcauuuuuguuguuggagaacagaggccccugggugaggaauucaagggccucaguaugggugugacuugcuaguuauuucuuugaaccuguuuuggcacuuagauguugucaggguugguuguuuugguuugguuugguuuuugguuucucacuaauuaggauuuggugaaggaacuuugaauguggacuuggagcuggguucgucuuuaguccugaacaacaaacuugcaauucacuagguauauguggaucauuaucauuaauucaagagaucauccauuaaacccuuuaaugccagauguucagaagaugguauggguuuaguguaauagaaauugaaggugauggcuucagcaguuuccuccucacaguguacaccuaucaguuucuguuuauuuacaucuugucaguaguuuagacauggaaugucccauagaggucugagcaagaaagucugggucccuuuugaugcuuuugagaguugauggauccuuuaggggguguggucuaaggguagguauugaggucauuggugcugugccuuccaaugggauuaugggacccuagccucuuccccuuuuggagugaguaguuuuaccucuauccuugaauuuacugcaauccucuugccucagccuccuaagggcugagaucacaggugugugaucuccugguugaagcuaccgcgccuggccuuaaucucucaguuuuuguguuuugcuauuagggagugaucacucucuaacaaaacuccuucuggauuaugcuuccacauguaccgcuuucaguaucuucagcuucuaggagugaugaucagcaagaacaugucugaugagaacauagaagccaguuagccuuucacuuacuguuaaaugugagaauuacauuaucuguaacaaauucuauucauaacucucaauaauguguauacuuaaccauucuuaucauuuguccagccugaaguuccugaucguccugccuccaccucccaguguaccacaugcccaguuuagaguuguaucuuaaacauuugucuuacuguugguucuuggugacacagacugcuuugggucacucugacauuuaaucaaauugaacagcuggcugguggagaaugcuuagcagguauuccuagucacccaagcaagggauuucagcagaauucauugauucauuucuuaagacuucuucucuauuuuacuuugccuuuaauuuuuuuuuuauuuuucuaagaguuuaucuagccagugugaccuugcucauuauuuacuaaugaacaguuacaaauuguuuguauguuuugguaauuagaaugugaucucaaucgccuaccagaugaacugacacuguaaugacacgaagucagcaacaauuaugccuaacaggaaaauuaauuauguaauccucucaucccauauuuugucuaagagauuagauuuggcugcgagcagacugccugggugggcaaagcauggcguaacaccucuugcuuguggcuggagcagcuaacaagagugcucacugugucaucuggggacaucuuugaucacuuuguaugugguuuguguguuuguguguguguguguguguguguguguguguguggcuuuugauucuaaauggcuauuuuauauccuaacuucuuagugaguaaaagugccucuucacucucagucucaaaggagccaucuuuugcccucucccuuccuuccucauaagggacacggagcucagaauggauugcugauacacagcaauaccccuuugacacagguaugugcauucuuacauccuggauccauggaacucauccguuccucuccaggacacaacaguuaacaguagcaacaaaguccaggguccaggccaggacugcaggagcugaggaccaccuggcaagcagcagagacaagcaccuggcugugugucuuagagucucuuggucugagcaggcuguucugcugcccugcuugccuccugguaccuaagguauugugaggcacagacaagguaguuggccuccuuauacagguacagcaggccuaagaggcacccugggacgaucuugccaacuucucauacccuggguacaaagcugaucucugagacgguuuugagauuggaccaagggcagagcuggggccacagaacccaggugcucugguccugugugguauucugccuguuggccuuugguuuuauuuuguucuguuuaagacguaaaacuggauaagcauaaagggacagugcaguaucgcucugacugacaagucgaagggaagaagccacagccaagucuuacaauuccgucuccaagagcacacugggggacauacuaccauagauuuuaaaagcacauuaaaauguauuuuucaaaagcauauaguugagccucugauaguuugacauuuauuuccuggcaucucaaagccuuucugugcugugcauuccauacuaacuuuguuuuuaauuauuugucaaguuaugugggaugaagacuucauaaucuacucccuguauguacuugggcauugacgucauucauuguuaguugguggcaacauuguuguaccuuaaucuuuauuuuaaauuauuuccauggaauuuuauuuguuuccauuuuaauucuuguuuuugucuuuugagaucagguuugugaggugguggguuuuuuuuguuuguuuguuuuguuuuuuuaaagaaagaaagaaauuuagguucuuucccuguaugcccagggucgcacuuuauucucugacugcugcuucugaccuacaugagaggugucaugccggcccugugagaaaugccccaugcauaagaugaaguaaggagauccuucagucucugcccucccuccaagcccauguucugcauaaaauccauaugcauucuugacugucuacauuuauagcgccugucaguuggugugcucuuagcuuucuucccuggagaauuguguauacuguugguucuuuggguacugagcugaggagccccaaacccauucagaugacugcucagacaggucucagugguggcucucucagacauccccuccccaugucaguccgugauuucauccaucuguagacuguuggcauuuauggcuauugccugaacccaaaccauguuaguuuuauauaaaaaacaggacacaaaacuaggaagacucggggcauggggcuguuguagugagcgagggcggcugucuuugcaauuguuuccauugagauguuugucguaguauuaguuagugaggggaacuuaacuguuauccucuaaacgugucucaggugaguuguguugcacaggugauagugauaaauauaaaacggauuguuuuuaauuauuagaagugauccauuauucaacaacaguagcuaauauuucagaagaaaaaacuaaugaaguagaaauucaggugagaucaggaaugugucuagguuagagaaccagggaaauuuugauauaucccccuuauagaaaauguggcuucacucucaaaagugcaguuauaaaguuaauugaauuucucacacacacacacacacacacacacacacacacacacacacacaccccagcuacuuuuggcuuaguucauuuaguuuuaaaguuaucugcggagagauugagaagaauuccgugguagccaagccauggugaauuaauguuccucacagaugguuuuauuuccuuguauaauauuauuuggaucacaaagcacauagcuuggaaaacgugagcaggaggccuuucugcuguagagaagugauaacgucaggaucgccggauguuuuguuucuucuuguucuccaguuugucuuucuuaaaaggauguaguugcugggcacugcuuggccccuuucacuuuuggaacaaucucuguuugauacugcaauguuucugucauuuuuaagaaccuuucauuucuuacgaaagccuugacuuuccuuugauaggaauucaaagccauuuacaguguauaacuuaacuccuuuaccuaucucuguugaugguuuucuacuucauauuucguucuuaauuaauaauguuaucagcacauuacauuggaugaguaucaggacguggagguggacauggaggugacuguguguggacauuuuuuuucuuucccuuaaagaaaaaaagacguagcaugagcucccuugugguuucuguuccacucuauuccugucccgggggcuuuggacauagaggccuccuuuagugccuccugugcccuuucucauucuucaagucuugagucaucuccaggaugucccugccagcagucugccuguaaguauugagagaaguugcaguuucuaaagugccaauuagaagccgaggguuggugggauaguggugauaagcuuuggggagacccucagcucaccuaccagcugccucagucugggagcuggaagcaaccacccaaacacccacccaacuauauugggaaguagcacaugcuguggauguagcugcugacaggcagggccuuggaaacccacagugggguaguugaaaauccuucuuucugccauuauuuuuuuuuuuagaagaaugagcuaauaauaaaauauaccaguaaugacuggguuuaacacuagguguaaacguuucauccuuacucaacaggccaguaaggacuggccaucaucauccccuucccauaggcuaaguguagucaggaucgaaauccaagcugaccugaagcagccaucgcaggguguuuccugccuccccuucugauaaauuauccacggggcgauuguuuucaaaguuuuguaugccuccgagguacucuguauauauucaccaauaugucgaccagucggucauuagcuguuugugcaaaugcagguguaucuggucucugcuuacaagagccuguaaucccagcauguggggaacuugaacaaggauggaauccuggagcccauccagggaugcuugacaagaccuagcucagaaaaacagagcaaaguaaauaaaaacuuacacauacaugcaugcacgcacgcacacacacacacacacacacacacacgcaggcacgcacacacaaacaguuuaguacuucaggugaucuaggugugugacucacugguagaugucuugauuaucauacauagagcucagaucauagauuaagugauccaaacauugugugcuggggaguggguaauauacagguggaaaacauacuguccuuggucuuuguuuuuccucucagcauguaaaaauaaauacaugcauccaauauauugggccuagguuuuuuaaaagggagcucaugauauuauauaaaggauaguucuuaacaguguuuuguauaguuuuaauuaauuuuucuugauguauagaucacuuguccauugcaaauauuuaaauaagauucuaaauuauagaaguucaugauuuucaugaaugauucuuaauuagcuaucuuauaucgaugggcaaauaucauuaaucuguuucccuuugcuccuaaacaagaugauauuaaauucucuuguuaaugacuacauauucaaccuugucuguuuacuguugcuuuuguguuuguagauaaggguacucacuguacugguucaaauaagaaccuucugugcuuaagcaauggacacucugaguuuuagucaguaacaguguauuccaucuaaggcuguuguguccauuccuguucuaauuuuaauugagagaagcugaugcauuucauuaaaugccuuuugacacaauguaauugugagcucuugcuuuuauuuuguggcauaauuuauauugauuagauuuugaaauacugagucaucuuugcguuccugaauaaaccauaauuguugcuaauauuuaauguuuuauaauagcaguuuugagaugggucuguaauucuuacuauuuugcuguuaggguuauauuuuuuuucauaugauuuaagaagaauuuuuuuccuagaaucuauaauuauuucuagaauguagaaaauaucugauuuuuaaauauuaacuguagcaaacugcaagauucuggaagaauaaaaucuauuuuuuaccaaugagcccuccuucagcccucuuaaaccuuuucaggguuucucuguguagcccuggcugucuuggaacuugcccuguagacuaagcuggucucaaacucaaagguccaccuaccacugucuccugagugcugagacuaaaagcccuugcugccagaccccccuaaacuuuuaaagaaagguuguguggggcacaggcuaggaaguaggcuacaggcugcgacuugaagauagugaauuagagaugagucuggcuauagugugagaugcuguuucagaaauccgaaagggcaaggaaaagugcuucuggguguaucgggguucuuagcuggccccccuuuuuuuauuuuuuacuuuuuccugcuuccuggguaaucaguguaucucaaguuuaaguucauuguccagagggagugcacuugcacuguuguuauuaauaccugugcuauacaugauacuaucccguuccucaugaacacuugggcucuuguucuuuccugaucaagcuuuauagaggcccgugugacuugcuaucguuaaaggacucguuacacuaaccuuuuaguuaccuuguguuuugauugugguggguauauauauuacuuuugaccagggcuuauuaaauugaccauccaucuuguuuccccaaacaguggcauccagucggaaaguuuguuggaggacagcuguacucugcaccuuuguuuguuucaguugccugcuuggccuuugauucugagguuguuuagacguuuguggccaaguuucucuuuaauuuaccuuuggauauucuguuaugaucgcugcauguaccucugaaaccucucugagggaacuuacugaggcugacuugaguccaagaacauaguuaauuuuuaaaucaagucagauuuuuuguuuguuuuguuuuuuuguuuuuguuuuaaauagagguuucguuuuccaauuuaguaaaucagacuuaacugguugcauuauuuucaaguccuuguuuguuguuaacugucaacuggagaaaaauguucaaguaucucuguaauugugugauuuuuuuuuucacuuuaagaaugcuuuaaaaaacaaucuacauuuacuuauuuuuguguauguguuuugccuguauguauguauguauguguauauauguauguaugauauguauauguacuguaugcaugucuggcacccauggaaguauggaagucaaaagaagauagggagcccccuggaacuguagccaagugguaagccagcauguggguguugggaacuaaacccugguccucuacagagccacuagugcucugaacugcagagccaacucuccagcuccuccugagaaccucugcccacucagacucaccugcucacagugccccacgucuguguuguguacaccaucccucuuuguuggguuugacccaucaguugccacacuugucugcuuuccucuguaacuucagcucucuauuuggcaccuuucuuguucgucuguuuugucugagucucagguuuguuuuaaggagagcuaggucaucuccuccccccucccccacccccccgauugacaguuuuaucuuucaacagaagauucugacuuucuuugcugacugugacaaugaauauauuuuugcaugccugcuuucuagcgugucauauauuucacacuuucuucuucguucccauguugaccucacaguuuggaaagguguguuguucccauccuguuaguguguugccauuaaagguuucaucucccccaccccuagaaacagaugccaguaucagaucacugacucucccuccgugaugagccuucaucugcccgucucuguauaguucccaccacguguaccccaggguucuguuuccagagugaucuuuuuuacuccuaaauucaugcucugugccucccauuguuuuucccuaauccucuggaauauaaauuuagugcucaagaacaguggauuuuuuuuucccuguucuauuuaaaagauuaaacugaaauucaagacaguauguauguguguucucacugcuuuucuauuuagguuccccugugcagucgauucuucuucgaugaguaccacccacugcaguccagcuuggucgcucugccccaggcccaugugcugucuucagugagucaugguuuuuguuggcuugcugauggcucuucucagaagucacucccaucucaagaagggacugcuagguaucagaugcccacucaggaagcagauaugcugcagcagagaugcucuguggcccuaggauggggguucagucuuaccauccacagagcuccuccucgaguugcugggucagaagaaagaccagggucugaaauugguguuccuugagauaggcuuucaugucuguaaaucacagagauguugaagccugccagaggcucaagaagcccuaacccaguauacuacagggaaguucuuuagaccacuuuucuuguugcuccuccagaagcagggucaaguauaauucucuaagccauugucuuccacauacgauuauaugagaguaaauuucguuuacuguauugugggaugggaggcagaaaaauguacagauggcuacuugccauuggaugcugcauuuggaguaauggcacgcugauggagcacaguugcuuucaauuaagcuguagggaauugagugcuuauauaaagggagcaugacagcgcacgguucuccuucagaaaaggcuauuucuuaccaaccggcacuuucguccuuguuccaacaucacuccauauauacuaauauguucucucaauggaauaaucuuuguuaacagcauccauuauguguguguaggugugugcacacacacagggagagguggcauuuccuccuuucacagcuggaaaacaugaugcaaagugccuaaccagcuuggcccgaauuggagcauugucauuggcaucuugaugcagguguuugugacuuagagucaugcucuauuuauacagaguggcacucgggcacccuagaaaggacuggaguacuagccuaacucccuggauguucacugucauuuuaacgacagucuuauuucuguguauuauuugaauuguuuuguauauuuuccaauuucuugguagcugugggugcgcaugcaaaagcaccccugugauuuaguuugauguggcaaaauaccggaccccugugccaccguagaagccucccuucuuugucugacgcacacgucuucuauugcagugggauacuauagaaauagcucguguccuugcgaaauugccagcacaaauaaggaccuggaaauuguugcuaggcauguaugucaccagauucauuaaccacuuccaugacaacuacaauauuuaaauuuauucgacugacuuagugugcauguguuauguguauaugugugggcacacaugucagggcacacauguggagaauagaggacggucuguucacuccuuccacaaugugaagcugaagaauugaauuuagguuaucaggcuugguggcacuaucccaucagcccaaggcuuuaacuuucauuucucuuucuuucuuccuuucuuccuuucuuccuuucuuucuuccuuucuuccuuccuuccuuucucucucucucucucucucucucucucucucucucucucucucucccucucucucccucccucccucccucccucccucccucccuuccuuucuuucuguaaaacuuuuuugagugucugaaacaauguguugggucuaaaugaauauuuucaagcuacuucuaauuucuuguuacauucuuuguuuguaauauugugucaaaucuaaaauguauaagugccuacaaaugaaagaacgaucugcucuggcuaccugagguucagccacaguuggucugacagauuauucuaaccuugcuagcuucucauuuuuccagcagccuaacugccugccccacagugugugaagucuuacuuggcguccaggaugaccagugucugcaggcaggaccacugccuucgcugccaugcuuugcucggcuauugcaugggagcacuauugguuuuucucuuuaaaugaagcauuaagguccguuuacacagcgauaaauaaaguaauuacuguagcuguggcauucugccuaagucaucuugaaaacugaaugcaaaaaucuuuuuaauagcuccauaauggucucuugaaguguuacagauuuuuauaacgauagcuguaauauaagugccauuauuuacugcgagacuugaacauuuugaccauuuacaugguacuugucugucuccggcugagcugagugugugacgcuguggcacugcagacauguggugccugccaagggcagucuugaccagguguggaaggccacauagcaucacugugacaccagaguaugucagguccugcucccugguuccuuggagaaggguuuuuguuuguuuuuguuuuuguuuuuguuuuuuuuuuuuuuugcuuuuguuuuuuuaauuuuuuuuaagucuuuuuugcaaaauguagauucuguuuugggaaugcugagucccugcccaguuugauaguguuauguaagaaggcacauuucuuguguuuucugauuaccauucuuugaaacaguccaaacaaagaauacuacaguaagaaaaggggaaaggaagcugucacucagccuuucuugagagguguccuuugcuuuuuugaugaaacucaugaaagccucugacaguaguauccguucucaauggucuccucuccucggguguuagguaauggagagagaugagcguagaagaacaucacugggcagauucuuucuugguacccacucagacuagagagccuggcuuccaugcuaauggaaggggaacagaccuucuuacucauucugcagagcggugucucaggugagccuggcucuggcuuucuaugacuguguguguuucuagagcacacauguuuccugguuaugugugcauggucaagcuuguugacucuucuggagaaggcaaauguuggugagaacgcuuggugcauugcaugggauuuguucuccuugugucugcauuagcaauaaauagacacuccauuugcauauuuaacacccgucuuccuucagccuacaccucuucacucugggauuagcuguucacuacuugaagcuuuugugucuaugcugggauauaacuuuccuccuuauuaaucagcaaaagucauuuaaaauggugucauuuaaaaugaaauagagaaauauucauaguugagcuuugguggguauugccauaguuguuauucucuuuuuuuccuguuacaucaccuuuauucuuguguguguguauauacauacauauguauaggcauauauaugugugugcauauauauauuuauauacacacuuuuauauauauacacacacacauauauaugcuccuauaauuuuugaaaguaaaaauaaauuauucaugugcuaaaacuuuauuucuucacauacauggaauguuaguguauauauacaugggagugcugggggcuucuacugaacaagggucaucuggaccucauuacaaguagaguuguucaacacaagacguggugugaauguugcaaaguguuuuuagagauaacagauaaaugugaucauaagcagugugacccaucaccuacuguuuuuugccuuacccacacuauagcaggacuuaauugcuuuucaugacugaauaguauuccauugugugaacauaaugaauuuuuguuguuguuguuuauccagaacaucugcuuuuauugcauaaauccaggaccuuggacaucuccaucauuguucuaggauggcuaugaauguuguugcugugugaugagcucuucucugucccuaccucccucugaaacccacaaaucuugccaagacagagaagugggaaggaggcacuuggggauugaggugaaaguacuugagagaaacaucuaguguuagcgugugaucaucccuguggucuggacuggucuuacauucagccagagucuuugcaacaucccagccuuagagcaguuccuccccauauggagacaucucacucuuucugccugcacacacuggaacuuaguuguggacccaggaucacucucagugaccacccucgagaccuuggugauccaguuaggggccgucuaacaaguggauauugcugugcuacagagugugugauggacaggcaugugguacaccugggagagagggucuucggguucaguucaauggcuggggcggggaggaaggcaguuuguggugguucggaucuggagcagcauguuaggggaaaagagaggcuggacuaagggcaucuuuagucuuaaagacaaaccugaagagcuuucccuuuaaaccagaaguccccuaauccgcuauuucuuaggcuuaaauucaacaguaaugaacugucccaucacccaagugaugaauuuagucccaucgggcuuuccaaaucccuagaaaucccuuuccuagcccacgagcuucacugagcacagggcuccacuuccaguuaucuuuguucuaauuccuaccucucagcuccccucaauuuucugcuuacuggguuuaugcuuuaaccaaaugagggcgagguacgcguauuuugaaaauuccaauuuuaugaaugauuuagcgagaacuuagacucauugaaagaagagcaucauuucauccuuuuuuaucuuuucugcaguaaaaucacacgcuuacauauugucaguucauaugugcacaagucaucaugugacugaaacacuaugccuuucagcuguuccaacagccuagaaaaacuggcuucucacgggggcgugaacaggugacuccugcagccccaggaaccucuaaagacaaacuuuuucuuggaggaaagggggaauuuauuguccauuagcacaucaagagcugcauuuaggggaccauuagugcuuuuagcuccaaaugaaauugcccucuccuucucucuuccuugaaacagauggaaggagcucugacuuccuggcagaaagccucugcgauaccuugugcaaacugcuuaauuaacaucucugagcuuuggucacuaccagaacaggggagccagcaccagugugucaccggaggaucauacugaacauuguagugacucugaacuggcagacccagaagcaggccugcccuuguugauguguguaugauuugaguagacugggggaccgaauaauauaucgcuugacuagucaugucuuugggucgcaaggauccaaccggacaucccuguggcaccuucgucguucucuuuaagaucuucacagcguucacuuguaccugcuguggugggaagugagcauuuugauuauucuugaaggcauuaaagcaugaccaucuugaagugccgugaucauccucuaccuauaauucaucgucgccucaguuaacucuguuaauucaccuuacucugaaaaaagaaucucaacaggaaguuauuuacccaagucacaaauucauaauccuauuucuagaaagauucuaacagaucuagccagccacauuaucccagggccaccuggugugagaguagaaccgcuuggacacgcccuccacgccuccugccuaguaagcuguccacccuccuagugacaccuggccagcaauuagaaaaccagauaggaguuucucaugguucacugggauucauuuauuuucucauccauauuuguuuucuuugcauucucuggaucauuagcuauaaauagcuacguuuuacaugcauucuuaauguaaucgcuuaauagcugcucucugggaggaauggcucuggcaugauuguuuuucuuggguuagaugagauaccaguggguuuggggcauagauuuuuuuuuuuuccuucuugugugcacucuccugcccccacucugucccccucucccuuucuuucccucucccacuccuguucuugaccaugcuagcucugauuccaugcuuucucucccccucccccucccccucccguuccugaccaggcuccucugauuccaugccaugacucuguuugggguuacacccuggagaugaagcacgccucaguucaggagguauuuagcugguugggcuuuguuugaauuguuauucacaucuuccucagauuuuugagaaacugaaaccaaaaaguuuauuuuccuuccucaaaaggcucuuaaaaggaaaaauaugaugaguuuuaacaguugugaauaacucagaaaauacuuuuauuguugacagucaacugcuaccagcagagcggcccgcuugcauccucuucuugucucgguaaaacaaaucaauaggauuuaguguauuaauaccuuugauucuuacuuaaaauagguggcugccgagguagagacagugagcacuuuuccuuugagucuguuggguuugcugugguggugggcguggcgucccugaagguuagggugcccccuguuggugccauugggcuagggaagagguggggaaugcugggucucaccuccgaagucagaacccucagcaucgcuuguguggggugacguguucuggagagugcugccaaggaauagaaauucccagagugcuucagucuguggacagcagcucacacagcuagaugggugccuugugccuucuggcaaugagguaagcuuugaguugauaagaagacagaccagccagcuuuucaaacaucugcuagaggacacugggcuuugggggccaguugaggcauaaaagcuccugucugugccgucucucuccugcucauccuuuaguccguuaaccgagcuuguguguccaggaauuucuguuguuuuugcugcaccaucuuguuuccuuuuguuggcaugagguagaugcccucuauggguucaaacuccugggcuccagagaccugccucauccucuucaauagcugggacuagaaacauuagccaucaugccccucuuugagaucuuuaauaauuuugauuucuauugauuccaaaucccuuuucugagguaaacaguuugcugcccuuucuacacuguggcauuaugcaagaggaaucggauuuuaaagcaaaagcccacagcccaaccucucacagcucucagcaucaagacaucuagacaaggugaaguggcaguguuuguuacaaaauaaaacuauguuuacucgaucuccuguuauuuuaacucuuuuuaaaaaaugucuuauuauuugagauuauaauuaauuccacauuuccccuuacgccuuuucuccaaacccucccaucucucuucauugucuuuaaaauuuguggguuuuccagguggugcugguacacaccuuugaucccagcacuugagaggcagaggcagguggagcuccagguucaaggccagccuggucuacucagugaguuccaggauagccaggacuacacagaaaaacccuaucuuggguggcaggacagcaacaaaauauuuaugguuuuuuuuucauuaguuuuuuauaugugcaugaaagcauuugcaugaguguacgcauguguguguguuccuaaauacauauucauaguauucauaaauacaaucugcucagccuauaugauguuagcaguguguguauguuguuagggcugaccaucuaggcuuagucucuuugcuacagaagucuuuagauuauuuuuuuuuuaaaaaaaggcaaauuuaaauauguaaauccuucaguuuaguggagauuauuaacauuucguuuguaagcaaacagcuaucuguccugugcaucuuguagcugauacauccaugaagggacacacuggauauuacuaaaauugcuuagucccuccacacauuaccacacccacccguuuugcucucaugaguguaagaucuuuaagaggaagaaugaaugaaugaaugaaugaaugaaugaaugaaugaauguuacuuuguauccucacccugugcacuggcuuccuuugaugcuuuuucugggcaggcucggguugucugcccucaccugcacugaggggcccuuuaaguccccugucuggccacaguggcacaggggacaggagaggaagcacaugccauccucauuucucuguuuuaggcuuagaaagaaauauguccaacagaucagauccucucagagucacagcaugucgcacuucuaguaauuaaaacugaagcccaaauuggauaagaaauaauuuuuuuauugauggcuggcauuugugaaaaagguuuaauuagaccaagauacagcaggaacuuauuggcuauuucauuuaagagacacuguugacuugguuguuuucugugucucguuuugccugagaaucugacucuuuuucaccuuuuuccagauaugcuaguagcaagucuacauccauuagccauagugguuauguguuuuguuuuuuaaugguacauggcacauggucaaggguauuuucucacacgguuucuucacagugguauuugaggaguuucauccccuucugcuugguucauucuucuguguucccuucuggugucuguggucuugggguggccucagguucucaugggcucucaggauaacucagcaacugcugucagugugagcuguuuugcaacucacaucccgucccuaccagcuccgcccagaucuguaugcugguagaggucuaccugagagugccuuccucaugugaaaaaauccuggcccaaauccauguccucuuuagaauuaauggugggccagauugaggccucacugaaugucucuguagggauagaaagucagaggaagagauagguuggguauugauuuuguuuguuuuuugcuuuugaugcuuuuuugcuuuuuuaccuuugaugaugguaguccagaggcaauuucaaguaccaaauuauguacuacaugcauuaggguagagcaagagggcgaucaauugucacaugagaaguccuaguugugucaucccagccuccccccccccccgccagucuauuugagugauaaaaauuugagccuggcuaccagucacuuuauuuagagguugacacugagguggcauugcugguaagcacuagauuaucauugugugcagagguacccauggcacuguggugggucuuugcuccaucugucuguuuguuuucuguccacaugcugaguggggacaucagaaagaugacugacacauacugcagcagccucuguccugucuccagugggcugcaggugacagcuucugugagcaucuguggaauucuuuucugaaggcccccaguccccucucucccuguguguucuguccccagacacgcuauuucaauucaauucugagguuccucugacuagagaagacuccauguagaugugauguugaugaauacaugccauguuuacucaguaugaggaaagaaccaagaauagaguuuguaggagugagucaaagaaggauguauauugauguucaaaaacuaauguuacacauagaugcaggcccagagggaucaccugugggggcccuguguuucugggaaggugugaaucccaggcuugcuuggcaguucauuuaugaacaggcaacaauuuauguaagaaauuugagcauuuucaguaauaaaagaguagaaaaccuucaggucaaggccgagcuuggguuucuggcuucuuuguuuuuauuacuggcgguuguuaaagagugcaagguguucuuuguuuaccagccacaggcuaaucaaguugcugauguccaggccgucccacggacucccuccuuccuucuccugagauacuggcauuuaaaaacagaaaggcagggaagcauuuaauguuuuccaacaguaagagaguagcucaaguguuccccguccagugguaccuuugcagcaguuagggugagggagagaugggcuuacacggcugagcucagagagaauaaauguaccccuucugugcucauacacacagccccaguuccucuccagagaaaccuccagacugugaacaaacagaauuuuucuugcacuaagugcauggauuuuuguaagagcuggcugcacggcagcuauauaauaaucgaaagcuuuugaaaugcaaaggcuugcggguguucaucuauaaggaaucuuuugacuuaacaaauuugcaaaauaagucuaaugcaaacuuaagaaaugcuaaaucagauuuguaauuuucuuuuuaccguuguuaauuaauuucuagagucuuccugaaaaagaaaaacucucuaguuuucaaaaaaacauauuauggauauuuuauuuugccuguaugucugucuggugccaggaagucuaauagaaggugucagauucccugggacuguuaaaggcagugagcugccuugugggugcuguggaccaaaccuggguccucugcucuugaucagugagccaucucucuggcaauacccccugcacccuucccccaauccccaccccaccccccuuuuuuuuuuuuuuuuuuuuuuugagaaagagucucaccauguaauuucugucuguuguguaucuggcuuuauagaccaggcuggccucaaacucagaguuccuccugccucuaccucccagguuccuaaacccuggguuuaaagguguaaaucaccaugcccagcuaucauuuuugguguggauuaauauugaaaccaauaaggguuuauggagaaucagagugaagggagacuguucaaaaagguuacuuggugugguuuagacgggcagggauccaggacugacagugagcucucguaaguccugacaaaagucaaacacaugaugaugacaggugcucacacauccugugcuuuccacgaggaagauguugaaggcugagugccuagagucacucucucucccuggcuggauagcaccaucacgaauugugacauagcucgcuccuguuuaacuugcacauauguagacucauacaggaacaucagaauuacagaagccugucucacacuuaugggcucaucuauuggaaggaauacugaguuggauuuuuaaauuauuucuggucaucugaguagcugcgagaaauuggaaauuguuugcagcauuggaacuuuaaugauuuucccccaccccccaccccccaccccccacgucccccuggcuucuguaccccaugcauuuuauuguuguccuugauuuugcucagguuucagguguauuucaaugguucaugucuauguucccaucuagacaacgcugggggcugggcaaacaucuacccuaccaaaagaggaacaagggcugcuguuuucugggaagcucaacuuggugaccgucugccuagguaaagaagaacgaucgugugagacaagucaguuucccaaguaaaagggaaaucugaugacauauacauugcccauuucucuaauuaaaaugacagcccaagcaagcagcaugugggaacuugacacucagaucaacuugcaguauccccuaagccgugagauccuagaagggcauagaucgacauuuucuuuugcacguaguaccuagccuuuuuguuugagggcuccuguaccugugugguacagcaggcacacccugaaguugagguuaagguggcauaggcucaccaucagugcuuccuucuggcugaaguccacagcccagccaggcugaucugucagaacgcugguggcucuaagaagcagcauacuccucgcauauggauagagcagaggcauagggcucaaauggguaucugaagccaccuugagaucaggagggaagccagcccuguggcuguuacaguggggaauggggcagacuggagucacuggccgccagaguagaagcccagaaaccaguuuuggguuguguuuuguuuuccuccguuucagucaauaaaucccucacucuuaucgucuggcuugacucagucaggcugacuuuugaccagucucaggaggacugaagaauuuggcuguggguuggauggacaucaugcucacacacuccagcggagagaagagggucucagguggggagcaguaucugcugaagcucucagggugcuucuucagucucuucaggucagccgugugccuucucuuuacagcuuugaagugccuguuuagucugucuggcaccugcaccugggauucagguuauacacucggguuccacuggccuaaauuuggggccagaacaaaagacagagauugaaaaucaggacuaccuucgacgaugccgucauccuucacagaagaagcauaacaucucuguuugcaguuguaaaaauggcaaagacucgacuaguggguugggauuuuauacuugagaauaguuccguuuaaaauccagaauaucguucagcuguaagaauggggguggggauacuauguggauggaccuucuggucauuaugcuaauaaaauagccagucacccaaagacacagucagugguuuuacuaggacagagccagcagcugcagaauagugacugcuggaguuuggcaaagacagacaguguaguguugaguuucugcaaguuuuacaggaagaugguagugauacccacacacagugugaaccuauuuaauaucauuuaaacauauuuaauagcauuucguaucuaaauguaucaaaaugauugaccucauuaugcugcaauucaaauggguacauguaaaaaggagagaacaugggagcuccagcuggcuguuggcuauuggaccagggaagcugggucggggucucccuggcccacuucauacauacuaccucaacaaucugggcuaaaucccgucuccaucuggggcauguguaagggagaguaccaccugccuccgucccaaccugcgcccucuaaaaggaaccucucuaaugacuuaugccaggccuucccuggugcccacccuagcugggugauucccacauacacaccugacuuaggccagguuuucgcaggaggccucccucuccucguuccccucugugcccucgagcccugccugaucuguuugcacagugcuauagugacagaauguaacagaucuaaacuuguuuucacguuauaaucacuccagggguguuuccagugccaagauugggcugccucccucccuuccucucagacggacugaaucacucuuucuggggggugggacgcggcaugaguccuuggaaagccaguaaggaccuucugcaagcagguguggggucagggcaucauguucuccuguucuucuuccgucuuggccugggcuaccuaccacugcuacuaccacaauuaugucuccuucagggugcucaagagccguacaugugguagaaacucuuaggggaggccugcuuaguuggucuaauauaggaaagccucaggcagcacuggcuuggugaucaagggaagcuuucgggaugcuggcauggagcugaugcugugggcuuccacugagagucccuugagacuuagggucaccagauuagauuccagcccugagcuuugggugaauccgcagguuccgggcugcaggccugagaagcucccuagcaccccugcagcucugcaaauaacaccuggagagcugcuguccugcugaaccaccuagugcccaucagggagcugcgugccaggaggaagaggacggagaguugaaagagugcuugcuuaagcacaguuucaagccggugccaaguacucagccgucuuucugccuuuaaucaugcagagacuuucuaaaucacauguaauugcacaccccuuugggcagcucuugacuggcucuggcuuucgcuuuaggugauuuuccccuuaaacuccuagaaggauagggcuagugggcaagagagagguuucuuucaaaaggagagacugcaguuuguaguggaguuguguuugcguaauaucccacauuccauagagcuuuuaagagcugcuuaccccgcccauuccugagccuguagcugucgaagagcacauguaugugugugaauguccacccucacuuuaaccauuggcauuaucucccucaccugcacuugccuaaugccacauguauaaugugugcccauguguaaugacauggucugccucaguaaugauuugaaagcaguugucgucuugucauguuagucugccgaugaacccaguaggcuaacaucuuaaaccaucacgccuuagacuggucuuccuggaggagagccugguugguacucuugucguuucugguacgugccaagcugcccauuucagagcuggacacaggugcuuagaggaacuucucaccaaagggcuucugggauuucuaaguucuugcuguuuuugugaccuccugugguuucugguuucacagaaggcuuuguuucucgguuuuguugcugcuuucagccuugcccuauaaucacugggcgccagggagggcugcggucucuuucccagggugcugugccagcccacgugugccaccgcagcagcaggagggugggagggggccaggaggggccaguguuccaaaacacaccaaagugccuaucaggccuuuguuuggguucugagcuugcccccagaagggaggcaggcacuccuuggagcugcucccucugguuuguuuuaaguggaccauuccuuccuucaugugacucaagcuuaaagagacuagguaaaugugccuuacaagguuaaaaguggggaacaguaaggagccuuucucgauguuuaggggcaagggguagguuguggguggacacggucuuuagucuucaugacuuccugugcagccugaggaugaccggaacuucugauccuucgcuuucccccuccugagugcugagaucacaggcaggugccacucggcccaguuuauguguccuaaauccaggucuucaggcaagcauucuaccaucagagcuuaucgauagcccuauugcaaaccccagggagaaaagauucuuacuuugaacuuaguuuucaucgguuggaggacaggaggcuuugagcuucuagaggccucaagaaagaacgugaugcuuuaggauacagccuucugugugacccauaccagaauaccucagcaucccccugcagcgaggagagguggcagcaaaggucuagggugcagguggcuuuggaaucuugcgcugaacaucccagggaugggacaggcaguuucuccaggccauuguagcagucuggaugaagucgugcagggcagggguguagcuacccaggccuggggcauuagccguaaagcacaggcuggaggcacaaugcacgggaagaugggcccugugcaccgugacagcugauggagagaacaguauguuaguggaaggaagagagcuuaggggugcaccaggacugcagaugucugcucuggccacagagaaaagcggcuugggagcaccauguauguguucugagagacagccgacagcguucucuggaggcucucguguggccacaugugaagagacugguagccagaaaaugggagacaggaaguagacuuuccaauaugaacaugaaugaagccggaugcuacugcguugugugugcaggcauggauugagcaccugauucaugacagcuagguaugcuacaggaagagcacagaacgaggugagagcugguuccgggcucaucugguacagagaaccaggagcagaaaaacggguccugagaucacugcaugaguggaccgcauggccaguuucacgcaagagugacugaaagagacggagagcuacaggccuugcccaucugccuguguugacugcugcuuuuccacaauccuucuccaagcuguggacuuuguucauagucacucacuuguccuuguccagaaguugccugacuacagauccauuuuauggaugagaaaacugagacuuagagaggggcugguguuuacucaguguucauguuggcuguaugguacagaaacccagcuuggcuaguggcucauagacuauaacguguggguuccuugaugaggagcaggaagaugggccuucuggggggggggggaggagaaggacugacaugguccugcuuucugucugcaugcugucuuugccuggcuuucugucuguaagcaguguccuccuuuagccccguguguguccuauggcaugaggaaguuagcuugcccuguuguagcucaccucuccacucccacagcaccaggccuccuucccaggggccucaauaguggccuucaagugugagcgggugcgucacaugcagcaggucucugguagugaccccuuuucauaugacuggucuccguagccacuguggaaguuagcguauccguagcucccugucuuucacaaacaauggaaaaacccauuaccagcccccaaaccagcugucugucuucugaugaauagacagccaaccccgaagagcagaagaauaguuucucuuaaguacucugggagugcauaauauacuuuaaaugagauuaaaaaucaugcguucuucuuccuagcaucuccgucaggccauugaguaugagagcauucagugcugugugcucaguacgagguaguaacaucuauucagcguucaguacauccacucuguucaagaacaauguauucaaggucaguguguuuuggcucugugacagacuucuggaaauucccaagagaaugaguuuuucccccccacugguuauauaaucuagcacaagugacuguguggcagcaacaucauguaagugacuuguaaaaugcaguugauucuaaaauguugcuuugaaaagaguggcuugaaggauuuuuguguuuguuuuguuugugucccaccccccccaaguucuuuccagaguuuaaggcaccacuucuucuucuucuucuucuucuucuucuucuucuucuucuucuucuucuucuucuucuucuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccgucuccuccuccuccuccuccuccuccuccuccuccuccuccuccuccucuuccuccuucuuccuccuccucuucccuccuucuuccuccuucuucuucuuccuccuccuccuccucccuccuucuuccucccccuccuccuucuucuuccuccuccuccucuuccuccuccaaauuuguucuggaauuaucuguaagcaccgcuuuguaguaaguacccuucacuaccccucuucuuucgugguuaaauauugcuucucccucugcacagaggcugagccuggagaaguuucagguauaguccagguugcccuccuuguagauagcagcuuugggaguucaagaucugaccuacggcaaacuuuauugacuuggagaugcacauuucaaaaucuuugcuggugcuguuccagcacuuggucaacacuguccuccaggcucucucuaggcgguagugacacgugaucauuggaggagagccagucuguggaagaggacaucucuuccauaggagccagagcauaaaaccgugucugggagcaggaauaggccgaacaggccugagcgagcaagggauauggauccaagcaacuggagaugagcuagugagcaguggguuuucuuaccaggcuccacaggcagggacaucauggggaucugaacuuaauuuucagugugguuauuggagaguccuacaugggaaguucaggcucuguuguagccuuuuaacuugacuuguccagguagccagggaugaagucagauggaguuuugguuuuguuuuguuggguuuuuuuuguuuuguuguuuauuuguuuuuuuuuuuucagucugugguaacaagcauucaugugcauugaauguucacaugccagacacuucuccaagcguguucuaauguaguaucucauuuaacauugcucuguggucagaaucgguggucaaugagaugacaaaggugcugguguaaaccuccacguuaguacccucuucagcacccugaguuucauaauuuccuauuuacggacgaaauuaacaugcuaauuacaaaucauucccuacuacucacucaggcacgcuagcuccguaaggaucuccuuaagguuuagauggauaacuuaauugaauugcuuaauguauuuagaagugauaaaaagugcauuucuuuuuaauuauagaacccagauaacaaggaguaagucuaacaggaaagguccagggcgucuucacaggaaaucugcagucuuacugaacaauauagaaaggccugaagacacccuucuccccuagcauaagaagcugaaagagugcccuguacacagcgauguacaguuucaaaacaguguuagcauuugauuaaguaacuguaagguuuuuucgugaggcuauaauggcgagaaagguuuaaaaguuuacuagugguguuuugcuuuugcuuuuugcuuuuuuguuuuguuuaagacagucuuauauugucacccuggcuacuagggcucccuggguugacaagguuauccuggaacaaucaagagauuugcccaucugugccucuuaaaugcugggguaaaagcuugcaccaccggccccaaaacuuuauaguuuauuuuaaagaaaaaguaaugaguggccagggaguggguggacuugccugaucaccuuugcuagcagucaaugcccacacaagccuguuacaaauaccauacaacagaucauuuucaacuccaccggaggauuuauguuuuguggagaguuccugaguagaaaagucugcuuauaaugcuugaaacccagguuuucaguuuagauuuuguuguuguuuaucaaaugcuuuugcacagaagcaaugaguuaaucccaguuaauguuuguugguaaguuaagagagaaucagcagauuguagggcaaguuuguaaaucugccccaccuuacagguuuccucaccagaagcauguauaugucacaagcucagggguagaggagagcccugcauccucacugcacugcaugucucagggcaugugauggagacuguggaccacacuggcuguucccgugacgcaggugucagacgcugacauccacuugagcaucuuccugugcacuggccuacacaguucacaguuaggugaaaggccagucaaccaagggaaaagcugauggaucaccuuguguauguguguguggagggguggaagacucacacucacacacauuaacacacacacacacauauauauauuuuuaaugugguucguaggcuagcuguucacugucucaaagcucuuaguagagaaggcucaccguccaacccuccagaaggaaguucauaccacuuuucugucauacucuuucuccuaaugcauaguggaaauuuggagacuuuuaauucuucaagagucuaagcuggggcauuacugcuauaaauggggucuaccuaaccccccuaauucugaguuugacaucggccggcaaacugccuugugcacuuaaagucacaagcauaacuuuuccagaauuguagaccccuguucccuaaauaccaccaaaguccuagauguagcuaggaguacccacguguugcagggauccugagauaguugguaagcccccaagcaugccaagcaccuccagaaaagagccaagccaaaauaaagaaaacgcauuaguggaguguccuucugucuucuucuccauccaaacugguauaggagaccacaccaggcccauaccacaugccguaaagcaaucuccugcacugggggauuugagggggggagggggaggggaagagauugagauuaagauuguaaccuuccagagccucacuucaggaguggacagaggaguccaugcugcagugguucauacugguuugagcaaauaaccuuccuuuuacuccaaagaggucuuggacagauuucaguuugugaguugcugauucagccacuuuuuaagaagggacaaaacuugguacuagauuuaguuaaacugaaucaugcauuugggaugaaagggaauaaucuuuuuuuuuucuuuuaacaauuuaauuacaugaaaaaaaaaucuuccuuaacuacaacugauagaaaucuaaauuugugucgagcagugguggcacauacuuuuaaucccagcacuuaagaggcagaggcaggaggaucucugugaguuugaggccagccuggucugcagagggaguucuaggacagccagggcuacacagagaaauccugucugaaaauaaacaaaaaguggucuacauguauauguuaugguuguauuuuaaaguaaugaacugcauauacauucuccgccuccuugagucuuuauugcaggugauuuggacagcacuguuuacauuagacacgcacagagcauaugugcagcuccagagagucccaggguccuucuccgccuccuucuuuaccuuuuccagcuucauacuuuuccuugucauucacagccagaccacucugauuggccuggcuauuuuuaauuguugccugauguuaggaggacaaggcaacuguugcaagcaccagauuaaguguuuauguuacauuacaaacaagccuucaguagggaugucuugggugggcuugcuuugacuugcaaauaguccugucagaacuuagcucccuaaucggcuuagaaauguguuugugccaguaacuuugaugagauauuaugauuuuuuuuuuuuuuaguuuauugucuuguuuucaccguauguguuccuaagcuacuaugauuaaaauagcaacuugugcuaagaaugcagucuaacuuagagauggcguuucuacaugcacacuugagcuaaguccccuuuuggagcugugacuuccgaugaagugguagugcacgggcaguagauguccugagucuggaugauguccuguaaccaaggcagugugguuugcaagaagccaucugcuuagccugcuugaaggcaugaaauuaauuuacuuguuggaauauuuuuauguccauuaaaaagaaaacccccuucauucccgagagacuguagagucacagacucgagcaguuacaagaaauuacacuaucccaugcuaugucugcgccccccccccccacacuuuguaaaacuguaauacaguuuggcaaacagcaaauugcuguugcugcaucaggaagcauccggccagugcguggguccauaucucuuuaccuauuacccuccuuacuguaaaccuccuuucccaaggucacaaagaaucuguacucccucucaaaggcuuaucacuuuagggucauuuuauaauauuuguuccuuuuuaaacaucccauaguuuaccuauccaccccucucuguucaggucuuggcaaauguaagcuuucuuuucuuugggagaagugucacaaguuuaauuucuauuuuauagaauaauagcugcauguuuguuuguaaagacacccaaacaguccagaguagcugugccauuuuuuaaucuauucuccucaacgaagucugagugaccagggguccccuaacuuccuuguguguguguguguguguguguguguguguguguguguguguguguguguguugauaugaagugcuaucucauuugugguuuuaauuugcauuucccugguggcuaaugaugucacacaccuucucccguguuuguuuacuauuuauaugcccuccucuuuggugaagcaucuguucaucuuuugcucuaauuagauuguuuauuuuguaauguugaguuuucagaguucuuuauagaucccagacuccagcucuuugucaggcccgugguuuguaaauauuuucucccagucugugcuuuaucuuuuuaucuccuuaacagucuuucaccgagcaaaauuuuuuaauuuugugaaagccugguguccugguuuuucuuuuuaugauuuuuuuuuucucuuguaaccuaaaccaggaacucugugucuagugauagauuccagggauccccugccccccagucccugccaacuuuacuguuugaugacuuaaguugaauuugaauggcgugagcuguuuggguuguuuuguuuuaaguaaaguauaagaaugagguuggggugaauuuucuccccgcucccgggagcgccaucuguagacuagacugcucuuuccccauuggacugaguuugagccuugucagcucugucaugugcugcacuggcugugcgccagacucucugugcugcugcguuggaguguggcuuguuucuuugccagugucaggaaguuuugaauggucucaccgcauccuagauuuuaaaaucagauaaccugaccccaguucuuccuguugcuaacuuaguuaccaucaccuugucuauacuggaaacaauguugcugggauuuuacuaggaaaugcauuauaccuuuauacagguuuaaggagaaaggacuguguguguguguauguguaugugugugugugugugugagagagagagagagagagagagagagagagagagagagauaucaacauuagaagucacacuuagcuucucuucaccuugugugauuuuugaucuaggguuucacacugaaccuacuggugacugaaccagcuagaauggcugaccaccugucacuguccgccuucuucugacuuuucaguggguucuggggaucugaauucagguccucuugcuuuugugaccuuaccggugagccgccuccccugccucacaugucuaaggucuuuuguuuugauacuuuguaguaaaggagaaagaacacagacacacuuaagugccuuugccuguguguuuagaagauggccagcuuauaaagggggaaaaucgcucccaguucuuguaguuuauaauuaugauuucaaaauucaguuuugcagcugaaccuuucauuggauugguuggugucucccaguaauuaaccuccagcucaugagaaugacuuauuguuacaaggaguagaaucucauuuucuuaauguacagaguguuuuuagaaguaauacugugcauaucuaauuuguaccaggaauugguuguaccagacagguaccugaaguucuugugaguuugauucuugaucuuccuuuccaucaccugucacaguuccuguucccucauaaugguggaaguaccugccguugcuccaaauuugagagcacggaguggaaaguagucacugguuugaguguuaagucauccagaguuaacgugauacauucagggguagacgccuuuacuguuuaaggacuguuuguaggaggugguaucggucaguagccaggacauagacacuggaauucaauggacuguggcuuugaguuguucuguggaguuuguccugagcaucugucagcacuguggggauaacuagaaacccuugggggggagggggguauuuugaauuuugcauuugauaacucgagucuguuacgauuacgucgugcauacucacauguaaugcgucgugguaguuuuccugugaguuucuccuggaucccauccaucuauaguucagacauucagcucuucaggcaaagcaaggcgcguggucugacuaagaaggauagcaccaguaaucauuguagaccuggagaguucaugcuggguuuccuuaagccagcucuaccuacacagccuacaugcgggagcacggccuagauagaggcuggggcuguuggucuugcuuucugaucuagucgggguuguuggucuuucaguggucagccacacagcagacccuuuucguugccccuuccauccuccaucuccugcuuucuucugauguucggucucuggguacccuagaaugucagacauacuuagguuucugcaaguacagccacuuaaacgcagagccuacagauaagaguucucuuuccucucagguugaccuacgugagggcuuugacuccaacccuuuaggaccagcauguguuugaaccuuggacauuaaggguaaagugaggaaaccuugagccuguuuuccuuggcucauuuaacuggagugaugaaaaaauuaccaccauugcagagugucaucacuugguacucuaauuguuaaccacugaguuaaaaauuauuuucaaugaaaauagcucauccagucgcaagggaaguacugccugugaucuuuccgggucagugagagagucacuucguguuccuuuguaugcuugaggacaugcagagaauuuccauggucuccucagaaccugggaacauaaguguucgccauacuuacugaacauggaaccccucugcgccuuuuaccuugaaccccagaggaaagucgagcucugcauguauucuucauucaccgggcuuguuuggaauugcucuggaaggacauugucaccaggcuguggucacaagaugguagagcgggugucuguacuuuaaccuccugaaauggaaaugcucgcucuccuguugcugcucuaaccacuccugaggucagggagcccaggaagauggaaugacagccucucucacccacuugaggaguucuuggagcuggguuaaggauugaaauggcacuguuugguggugacauucccuaagccugcaguguaguguaaauacucacaggagcguccuccauccaucagcaagagacuaguuucccuggguccagaguccaggaguugagaagugccgcagccugccucccucccggagagcaguccugguguaggguaguuugcccuuuuuuaaguccugacacuuuccggacuacagaacagaauaaagucagccucugccaaccugccucuguauaugaaggacuuggcuacaaaguggccccauugugucccugaauaaaguacuuuuggaaaaauaccgaagucaugccuacagaacgaaccaccacuugaaagcgguggaauccauugaaacccacugccugacugaaugcugggaacagcgguguuggguuacaagcuaaggggaaauaacuuaguaaagccaugugacugugugacucucagucuaaucccuggugacacguccccuuugcugcacgugacacgugagccucaaguccacuguuuuguaggcagaucaacucaccccagguagauuucuaacuaaaaccaguuccacauuaucaauggaccuguccgucuggaagugguuggcuuggauacauggcagguuuuuugaaugguuuugccacaucuguuuauacauacaccuggaggcaggaaguuucuuuuggaggcaaggguaggguggggugguugacuggggcuggggaggcagacagaaauauguuuaugguucucaagacugcuuucuaccccggggaaggcagguugagaacagauugccucuggagucccugggcauauuccagugguauaugggaauucuguucuuuccgagcacuuacuguaaauuaauaaagaauuuccaugaaucuggauauauggcacgcuggauugaagggagcggacacaggauugagugcuugagacucacuccacguggcuggauuuuaaucugaaaggaucugauuuuguggcacuuccaaagguggaagagaaacccucuucaccaucccaggagauguaggguguuagaagaaaaaaagacguguccuucaagccacaagcuguguguccacccugagccugucccuagccugaggugcuuuggacucaaugguuugagugucuuugggaauguaauuccucucagaguaucucugaggcacuuggcaaagacggggcucccucuugggggaccuuucccugaugguguguggguaacgacugcgcuuucuguguuucuucagacugcuggcuuuucugaagcuccuuaagagcaccugucacaccgagcucugucagucuugaaggacagugacugaaggacacuugucccuggugugugaacaagggauugugcucagggcaaaggcaggagccacucuggucauuuuucugugugaggugucucccccucccccuuuuaagauagggccucucugcauagccauagaggccccucuucuuccuccacuucuguuucuuugcuuauuuuaucauuauuauuauuauuuuccuuuuaaguuuuaaaggcagaaugugggcucugagagcaagccgacuugcccuggcuggcuugcgcgcgcgcucucgcucucucucucucucucucucucucucucucugcucauuugccuuccuguaacauggaaagacaaauagacccuuaaaccugacucucaaagccacugccaacuuuuuccuuugugcguaaguaguuauauuauuucuagguuacgcucuuuaucuuugaaagggaaaagaaacuaccauggacuguuugcaggaacgcauuguuccaggcuugccuaguuguaccugugaugccauuuuccacuuggaaccacagggacgauaaggucguucucagacggugagccuuuuaaaauacaaaacacauaacuuuaauaugcaguggucauauuccucuugcauauggcaugucucucaaaaaaaaaaaaagaugucagaguccagcaucuacuauccaggugcuguuugcccccaccucucugaguccucacuugaggagauugagguagcuauuuaaagcaggcccaggacacacauagugaggucaccuugggcuacagagugagaccuugucuuaaaaacagcaacaaauagaaaaagaaauugauuauuuugugccuuuccaaagaggcagugugcaguuucuuuaaaugcaguuauguggagcugugacuuuuaaaguucuucauugcggugaucuugcucucuggggcgugucuugaguuggaggaugaucuuauaguuuaauaaggacugcagacaaacagcagugcagggcauaucuuucagaucccagcagguaacagaagggccaucucguggccugcagagcacuuggcauucuaggaagagcauguugaggagaggagcaggcuggaggaagauggucagugggaaagggaagccagggugcuggcugugacuggcuugauuugcuuggugugcuacauacaucacuggucaguacagacuaccugugacagccagggagaggaaaggcauguuugugucucuguuucugugaagucugugaccugggacuuugcucuggguggguuucaguccuucaguuccacuugggguuggggaggcccaggacacugaaggggagaaugucuccaaaaucaaguauguauauguuuaccuccauguccaagguggcccagcuucucacagugaugggggaucagcaagacggguguuuuaacaugaagagggucaccuuuguccuuauccagaauggauuuuuagagaaacaugugaacgagccauggggaauaauuucauccucccuguucuuacagaugcccggucccuucauaagacaguggcagacucugcccaugugagcaggaaguacagugacuucgacaugcaaacauuucuggaaugguuuaccucaaguccaguuaguacuuccugaaggguccuguggagcaggagcugggacaaagucagagucuacacucuagaagaaugcaggcugcgugcuauagguggcuuacagccuggagcaucugucccagaagagacauauagaaggcagagaauugguuccccagaguauaacucucacagaaguaaaacagaaaauauucaagccaagcaaaaacuaaugcucuuuuauaagaccuguuuuuuguuuguuuguuuuuucucuuucauguugagucguuucaagggacucacuggccgagguucugacccauuacaguaaauaacagauguucaguccguuuaucuuacaauacuuaaaauaaaagcagaacguuaucuuacucucacauaaaggagaaaagucacuauaagacucugguugccuuugaagaagucuuauaccuaggagacuuuacuccgcaugcugucaaaccaucuguaagccugcaguacacugacacucacccccaacuucuucuagggaacuuuuuguagcugcuaguuccuggcagggugguuugauaguagugauagauuguugauuaaaauauaugucacagugccugauggguuauugacauuaaguguuaacgcacuccuuuucacaaguuugugcagguguggauucagguguguagguggggugcagguggggguucagguguggagguggagugcggguggggguacagguggggaugcagguggggguucagguguggaggugaggugcagguggggaugcuggugggggugcgggcgggguuucagggugaaggucagaggacaaccugguaauguuccuuagaugucauucaccuccccacuuuuugagaggguguauguauguauguauguauuuuauguuuauggguauuuuauuugcauguauaucugcacaucagauuaaggcaucggaucacauucuagacaguugucaugugccaugugugagugcaggccgggaacuggacucaguaccuggggagaaacauccagggcucuugaccacugaaccaucucucuagcccccccuuagaggguuucuuauugaaaucaaauucagcagguaggcaaggcugguuagagagccucagggccccaugagccccuucaacacaaggauuacacguuuguaucaucacaccugccuuggccauauuaacucggggauugagcucagguccuggugcucacaaggaaauaaauacaccgauuaucccaucuccccagcccaaggcacaucuuuucccugcuuaaaucaucaucuucuggugcuccguagacaccauggguaccaugagccuuuccuuuaacauuuaauuuuauguugaauuuguuaagauguuuagcuuuuauuaaaguuuacucacaaaaggacgaagcaaggaagauuuaguggucugaugagaugacaguuccggucauuuacuuuguaaugugugauugauugacagacuggauaagagcgcuggacccccuuccccagauugcccgauuucaguguacugacucauagaagcgaaaaugcaggauggaguagagagcuaggcccaagggaaagaacccaucccaagagauaaggggcucauaccuucuuaaguuaaaauaaggcugugugaucgauaaagacugaauguguggugguuguucugugaucaaacacaguuggcagauaaaaaggauauagugaguucacaaucaccagugugauguguggcgcauuuguacaaacuggaggugugauuuagaggaggaguagaagguagaaggggagaggcugguagagcggaaauauccuaccuacgguguuguccacuuuccugucugguagaguacuggagcuauagagaacauggggucuucagucuuuaauucuaucugcucaucucaaugggaaaugacugauacccagaugaauauccaucaugaagggaacuuaaguguuugcaaagcauuuucauuuauaugagaggccugagcauccucaagucaaacuccauaaugagauuugucuuuagaaauuuaaaagacgggcuggugagauggcucaguggauaagaacacccgacugcucuuccgaagguccagaguucaaaucccagcaaccacaugguggcucacaaccauccguaacgagaucugacucccuuuucuggagugucugaagacagcuacaguguacuuacauauaaucaauaaauaaaucuuuaaaaaaaaaaaaaagaaauuuaaaagacaaagcauaaaucuaaauuuaaaauguuuuuggucugaugucaauucagaaagagacuuguuuuuaaaacaagucaguauugugugacgucuguauuguaaggacaaauggaggugggcaguguucccgggggcagcaguuuaagauggucauagcugcuccauuuauguacagucugucuuauguguaucugucuuauaguaauaucccuagggaacaaaggggaaggaaagaggagagcuccaacuucagagcucaaaucuuaaauacuauucuucauuguuacuggugguuuucuugugguaaguuggagugaaguuuuggaguguuuuguacagauacucguggguacgugaaaaacuuucggcucagugagagucgcuguuuucuuaggaguugacugcuugggaaauccaaauacagguuugagauuaacaggccuucgaaguggauguuucugugugccgaagcucuguaaacacguguagcuugcuucagcauuguauaacauguauugauuuuucuauuuccucuccagaaaaucucaggcccuucuuuucucugcagacacaaaggcuggacuguucuccagaaucaccacuggggaccucuagggccaggucacuacugucaaaggggucugaauucuccagguuuccccuucuccucacaaaacccccaccaggagcacagugugacaaugaagcugcuucuuacccagcacaagugcucguggaucugcagaucccacugucagaggugacaugugaacaccagcuguuaacaggaggucuccccucucggagaaacaagcacuuacaaaagaacguguaucaguaaacucauccauuucaaaagcauuuucagagcuugcuaaugaaaguggaggcuuaugcaaagucacuuucucccaccaaacccuucccuuccuuccagugaugauguaguguuagggcuguaucauacccuuugagucacagucucagguuaacucuggugguagugcuacgcagaauacauuucuagggaaaaaaaagagcgaugcuuagucaaugcuuucuuacaguaucacagagagaggcacaagccugccaaaaugacaguuaagauacugcuauuuugauagaaauauuaguaaaugucauauuacccucugcuaaauauuuauagcauagaauauaaacccuaaugcacaauauuuuauggaagaaaccuccuuugucucauauccauuacacugugcugacauuggucuguaguuucccuccagaggccugaaggaagaaaauguuauuaauacccucuuauuccagcggacauaaauuccauuccaagaaagcaccuuugagucuuugguucuucucaaaguggaauauuuuaaaauauacacauuuauucuuuccuggauucaaacaucaaugcuuuucuuuaaaggcacaaagaggguggugguagaagcaaauuuugaguuuuugagagaaggcagcauguucaggagugaggcauauggccuauguauauacgugaggcuccugucaggaaaggagagggcacucagaaauugcagugugcucugaguucagcucugugacugagcaguggugcccaguagcugugauuuauaagguaauaugugccagacacuuuucucugggucguuuacaaggaguagucuagaguuguacaggcuuugguucuuggucauaguuugggguuguaguagauagagccccaaggcauuucucaggcagguguagguuucaugccagcucugugaggcgauuccaccuaaaaauguauggguguaacuucuacucugugcuaugagaaguugucgguggugguccucagauuggucaugugugagaaagaacugugccugccacgaaacucugugaauggcuuaaugauucucuacagugagccuacgacuauuuuuauauacaaaguggacuugaagauuaacugguauagagacugccucccuccggcagcaggaaagugaccugucuguacaguuccaucuccacgguaaggugauccaaggccuguuuaccugcagccacuagaaacccuugugcaaauguuugcugcuguuugguaguugcgagaucaguaaccguuuuuuuuuucagaauggagugauuucagacacaguuugggaaacacuugaaauaccaagugaccuuaauucacuguaacucuccaacuggaaaaugugcccaguguguccuugaaucaagagcccucaccucuucacccuugcuggcucuguagcuaucagcacuccugcuguguggccagugggcucccgggcucccgccccugcagccuccuccccugcagccuccccugcuggucuuccaugcuuggagugggucacuugcccuaacaucguuuguaguuuggcagaaaccauguguguguguuuccuugaccuuaaccucacuguguacuugcucaaggaauaaucugaaucugcugaugucuuaacuacuaaaucauggugacauuucauaauaguuaaucuccagauccauaagcaaagaaagugggggagcuggaauauuggaaagacugauacugcagcaguaacagauuguuuggaaacaguaagguucaaauaaauauugugaaagagggcaggagaagaaaaacauacagcaaacagcaucucgugcugcuuuaacuuuguucuaggcuugaaguaaacaguuggaguuuuuuuuuuuuuuuuuuuuuuuuugucuuaaaggucauucacaugcgccaguagguaacaauaugcaaauccuuacguauuguguuauuacauauuaguauguguuucuuugaaaaaaauguuuuugucauuguuauuuuaauaugggaaucgggcugcccccuuaccucagcuuucugaguaccugggacugcagacaccaugccucacuaaucuaaagggaaagcuguguucuaugagcugucacuucuacagggaacgauccagauguuugauaauacuccaggaggacauagaaauagaggcaguacugaagucaguggcucugcagugugguuuauagccaaguuugucccacgaccugcagcagugagggggagacacauuggggcuuuacugcuuguuguagaagcacacugaaaugccacaauguugaaaugagaacgaagggaacaagcccuuccuuauuucaaccucugcuugccaaccuagccucugccaggugacuugacuugagagucccgccgguuucugucuccuggagacacuuguugaucacacugguugaucacuuugaugugugaacgucacaugcaugacuuagcugcgggaucucaugacuggugaaguaugaacgucacaugcaugacuuagcagugggaucucaugacuggugaaguaugaacgucacaugcaugacuuagcagugggaucucaugacuggugcagugugaacgucacaugcaugacuuagcagugggaucucaugacuggugaaguaugaaugucacaugcaugacuuagcagugggaucucaugacuggugcagugugaacgucacauguaugacuuagcugugggaucucaugacuggugcagugugaacaucacaugcaugacuuagcaguaggaucucacgacuggugcagugugaacgucacaugcaugacuuagcagugggaucucaugacuggugcagccaggugcuuguuccuccuggauguguuugcucacccucacagacagaguccugucugucgaaguucugaaaagcccgcuucugaggcaucuuugaggagacaccucuuuucuuccuguauauggggugcugguugguguuggaaugagucccacuuuuaauguuccccucauccugugugggucccaaagcucuguauguguauggucgccuuuguggucaguggacagcuuguaccacacaagcagugcuccuuuuuuuguggguggaggguugguuucaugacaggguuuuucuauguagcccuggaacuuauucuauagaccaggcuggccucaaacucagagagaucuuccugccucucaggugcugggaguaaaggccugugugaccaccucaggcccauuguuuucuuucaaaugaagugaccugauguuccuacugcgugggcuguguagccaaagccuacuaguccucaggcugcaaauggaguccuauuuuauagcuguguccuccaggcagcuguggugacuguuuacgcagagacugcuggcccucuguaaacuuggucaucugcagugacaguuguuaagcugcuaguuaguaacauauuuaauaacuugguuuuccuucugaacccuuccacuggguaugaccaaccaacaugugugguauucucaggagcccaggauggggcuauaguucaguguuggagcacuugccuagcaugugguagggccuggguucuacccguagggcaguaaaccugcugagaaacaaggucccucuaggccccucucccuuguaucggucauaauagcugaaagagcaucuguauguacaacacuacucuugacaaauacaucuauuugacugaauauucucuuuuacuaacccagccacugggcaaucagagaugaacaaagccaggugucugaaaacagucaccagaacaaaugacuaaacagaggagagcuaggaacugaaguaaauggaagcagcuuuuagggaugggggcuugugguuggguucuuagaggccuuuggaaauguagcuguuacuaacuuuauuccuugacaguguugugcaaguauguaaugcauuccgacuacucucuacccaucaucucugggcuccucguccucaucagccuuuuccugccuccuuucgcauucauuuccuuccccucuuauccccugugguccguccccccccgucccuccccccuaccucucucucucucucuccccacuuaauuuaacugagaaugucaaugucggugugaguggguuuggaccuauccguuggaaccuggugggcucagcagcagcuauucuccuauuccuuugcucuccgauguggguaagagccuugaggugagaagaucugagcucgcucgcucauuccacaaauauuuauugagcaccugucugcgccaggcacucuucccagugccagggacagugggguacguggcaggaggcgagcugcucauguauggaugauguuuagagagugucuagugucuguuuaggcagagacuucagagaagagacaaaggaucuuuagaagaggcauaggaaagggagauguuaaaaggccugugucccgagagucauggagaaggcaaagccaauuguguggagcccugauaugguggacuugccuuggccacugaagaggagauaguagguucugaguuauaccgugugcucccuggaaaagaaaacuguugaucuugggagggggcuucugggaggaggcugcagcccaccuguagggcagaaauaagucuuaggucagggugguaguucuaagaguuaggagaagaguguacuaacauguggaauggacccugaauaggccagggggaaguagauuuugcaugucccagucuggaugcuacuuuuuguuccugagggaaguuuuuauaucuucaggugacuguggccacacuccacacuguuuaaggaauguguugcucguuaacacaggauguuuaaccaggaguucagguuauuugugcuuuaaaaucugcugagccugaauccaaagaguaauucguagacaacaucauagguacuuguuuccuuuaccuagaaaguauguucauggccacagagucaacaggucuccacgagcacucuuaaaggacagccagcaggucagagacaaguuucaaaacaaaacuccaaacugcuucaggcucuggucuaguuccuuauaaaaccuggcauaauuccuguaagacuuguuuauuuuauuuuuccucagcucguuaucuugauauuuuugccuuugaagaaguuauagaauuauugcaauuuaaucacagacauguauucuacaagaucuauuugauaucuccugguuacuuucuuguugcuuaggccuucagucaggauagaaacauggggcugaggaguuaaucuccaugcuuugagaaacaugcccacuugaucccagcacuguggggcagaguggguuggcgguguuagagguagacuguucuggaaauguagcaugcuuuccuacacucauucauauucauucauucucauucucucucucucuccccccccccuccccccucucucucccucucucucccucucucuccucucucuccucucuucccucucucucucucuccuccccccccucucgugucuccuuccauuaacacgaauccagaaaauggguauuuguauuuaggccuguuucaagguaggacagaauacuagguuuaauuaauugauagacugauuaaccaugggaauuccugaccauccuuagggcuugguacuuccuagucaauacauacauacauauauacauacaugcauacauacauacaaaaaacaacagccuccccugguuguggaggaagcaaaagccaggcugugaggguuugccauauaaauaagcgugggcuuuggggguggaucuguaguccagagggaacauggugauugccauuagggggaaaaaaaauuaagaauugagauuacuccuuagcuucucagauuuuuaacagccuguagaagguuuagauguagugauaucaacauaaaaacagccaauauuuuaaaaauguaucuuuugggaaauauauugucuccuucaaugcaguuuggcaaccuguaauaagcugacagccccugucuuucuaagaauuuuuuaauaaaaugucagggaaggaaaaguguaucagcagauaggaguuccuuuaauaacacaguagguguugguguucguguuaguguuagaaccgcccagacaggcaagcagcucugagaaaugcccgaguagccugggcuuggcuugaguaagagaccagcugccccagaggccccugcaagcuucgcacaggacgcagaggccgagcuggugucugagcacuucucuuuguuucgcuuguuuucgaucugucuuagaaaauacggcggccacaaacccagucccagucccugcagcugcuuggucuuuuuaugaaugaggcccagaagggggaggagaaggcuugcauuacaccagccguuggguaauacaauucauucacuugcagccauccaguccaggcuuuuauuuuaaaggaaaugacuuguuuauuugacaguucagauuagccccccccccccgcccgccccccacuccuuccuggacuuaguguguucaaacacuaggcuucaacauuaaagcuuguguucugagcauuugcucaauuuaauugggugaaauaguaggaaagguugauuaagaaggggagcggccuugucaccuccugggaucuugguuacuccucugucccugugcuaucuaagaggagaagccuugcagucucuuuacucagccuucagaccuuugggagccacaagaguggagugcuuuuggcaaggugauaccucccugaggccugcccagaucugaaugugccuucuuacccugcauucuuggcuugcuucccuauccugcacuggcauuucuuuaucuguagcauuuaaggccccauuuuuuuuuuuuuguggcgacuaaaaucugaauuggaaagugugugacaagggcugguccucuccccaccaccacuuccugcuaggggaugaacaaaaagaccagccauuguccugagcauaagucaaaacaaacacccauaggaagcggcagccugcuuacagcugccugagugagcccaacacugggccgcauugccucacaaagagaccguccugggcauggagacagaccacuggcauucacggcacagaucugaugcugaccaucuuugccaugcucaggcagugaugucugguuuguguccaugaccacguguuugggaaagggcauucucuaugagauguuauuaccagcacugucuguguguauguauguguauguuagagagacuuacaguuguucaaucacaaguuaaggacuccauucuguaagacagauauuagaugcugguggaagaagugacccuggcuuugaccuuuucaagcccuuaaugccacaucuaaguuguucuuagguuuucuugugggaaaggugggguguauggugggguaguugugagccaucucacuauaggugcgggcugucugaaagggaaugauaugucgacuugauaaucuugagucuuccuggcuaguugaacuuucuggaaaaugugaguguguaugcccaccauucuugccaguguccuagcagggugaacuguaggcagacaguguauaugaacucuagcaugcugcugcugcugcuguuuucuuaagaguuacuuauuuuauguauucgaguauacuauugcugucuucagaaacaucagaagagagcauuggaucccauuacagaugguugugagccaccauuuggcuucugggaauugaacucaggacuucaggaagggcagucagugcucuuaaccacugagccaucucucuaguuccaugcuuccuaaaaccuagagugaacaucugggcuggaauagcuggaaugaguugacagcaggauguggcuggugauucuaauacaagguucuaacccuuacaacugacagagcaaguucaugaauacuuccccuaugguuucuuguaaguagucuuguaauuucuggucauaaauguuuugccuuugaauagguuauaaaaguguguguguaugugagugagugugugcguacauggauauccauauccauauccucagggcuuuuaucaaauacugguugauuggaaauauguugauuuuuuuuuucuuuucucuguuuauucuguaaccagucuaggugucuguuuuucugucaguaccauauucuuuagguuacuguagcauuguaacaaacaugcacuuguagaacuuucuuuuggggcacuuuuacaguuguuuuugagacugugucucauauagccuaggcuggccuuaaacucucuauuauccuccuggcuccaccuuugcaguguacuuugaagcugggugauguuuuuaagcuuuguacuuuuugcccaggauucuguuggcuaucagagguccuacagcagagcacugucauacaaggagaggaagugaaacaugcagaguggaaaagcugggcagaaggagaaggcccugcauugcccagcggucggggucucagcagaggucagcccacuguagcguggaagagggcugaugaggugggacugagaacugaagagcagagcuguguucacuugauuuugggggugauaucaagagagccagaauuguuaagaacugggaggguuucagagacguugugaccaacagcugcuuuguggauguggaguaagcaguauacacacuuuaaaucuagcuccauggaagucauugaguucacaucucaauuagcauccaguuguacgucagugugugcaaacaugcgcauguguauuguauuuauuuagcaucauugaaacaggcuuuggguuucuuuuuuuuuuuccccucgaguugauuuuuuccaaauaauugaagcuuacaucucaguuuaauaaauauaagccuuucuucucaacuguuaccgacagaucuucauuaauuaauaacgcaccauuuucuucguaauacagggcacuauuacaaagucugaagccguggaaccuguuggcacaugagaauugguuuuguuaaagaggauugggcaucugugugugcuuguauguaaugcauugugucuguuccuguggcauccuggcaccgugagucccgauccuaggcugucucucaguaaacuuguuuauagcauuuucacccaccaagggcagaagacucucauuguugcuuuuaagugggcaucaggugccaggcauuugguggcugagacacuagaacccuguccaucacuuggauauggacacaaaugggagauccugcuaacgguuaagucucuccuuguguguuagugcucuuucgugaguuguucaacuccuucagaauccuggcuccucugucuuacuuugccaccccaugacuccuuauguuuucccagauaggaauuguacuaaugaaaaugagaaguaaauguaauauguaauguucugucgguaauuguuuguuugcauuuuagcuugucauggagcuaaugauauuuuaauuguagcugacuugaaacacaaugaaaaaguggcuuccugcuguuuugggguuuuuuugaggauuuuuaaaagccggauucagaaacuugaagguaauuuaaaauguuugagccccagaaacauauuuauauucuacagccaugaacgaaccaggcagggcuuguauuuaaucauuggaagagauguaaguacaguaaggaaacaaacagccuggugcacacauccauuacauuauugcuuaugugcaggaaucuuacaaagccugccucacugaagcgcuagaaugucauacaugggcagcugggccaaugcuguuugauuuuguaagagagucuucuauuucugaaugcuguuccacacgccagcucucugaggcuaugugaggacuacagaaggaaacagaaggcccggauagagucgaaggagaaacacaggagcuuugcaggaaggacugugauuuucuugcugaaugagcgucaagacugaugcaggggugaaagcacuccagguuaaaccugggcuggggaggggaggcucggggagagguaggggucggggcacacauacagccacagaauuuugauugugguaugugauuugagacauuuagaguguaguuccuaauccaucuguuggaagaauuggugagcugcagagaacuuuugaaacaaauggcauucucagauaaauacaggauaaugcuuugucaacguuuaaaauuuacaugccgccacaaugugguggucccuggcagauuauaauccuugucccgaggaaacuggggcaggaaggauuacugugagccagccuggccuacaugaaugaauucaagcccagccugggcugcagaucaagaucacaucucaaaaaacaaacaaacaaacccaauucagcugccaguguugacaaacuaagcuagaaguucaaaaggagccuggauuggacaccugaguugaccucugaccuucaccacaggcaccuacacacacccacacggacagaguucugauggguugguuccuccucugcacgccaaccacgaguguggcuccagggcuauuugcugcaggcccagcaugugccucugugucugggcagggacauaguucagaauagugggcugauucguaucauuccuucuuucuacgggugccagugcuucgccaucguugaaagagggauuccagcuacccuagcuagagccuucuuaucugcacaccccacccugucauguucucgagagcccaacggagguauuugauccccuguccuguuuaaugaaucaaaugccuaaucuugguuccuuuuuuucuuuuuuuaaagauuuauuuauuuauuuauucuauguaaguacgccguagcugucuucagacaccccagaagagggagucagaucucauuacagaugguugugagccaccaugugguugcugggauuugaacucaggaccuucggaagagcagucgggugcucuuaaccucugagccaucucuccagccccuaaucuugguucuuaaaagaaacuucagaauaaaagcugcaguucugguaagucagagccugccuuguuccuaaacccccaccaagcacucucaacacucugaaauguuuguacucacaacgcuccugacucccaguacgugauuuucaauacccacaagcaggguuccagccccgcaaacaccauaugguaccugcaaaucgaauguaguucugacacccaccaugcagagccagcacauccuggugggauccucugagacuguccucucacugaggaaugcagagguuugagugaauagccaguuaccccuucaacaugaucauuugccucaguggcccccaaauggcagaaaauguagcauugcuauuuuagccaggcuguaacucaggagcagcugaguggaagggcaggggugagacagagccugcagggucauggucuggagcagguuuguaggaguuucuuagggaugcagcucugaaagcauguucaugucuuaagacgacccugggugcauggaauucucuguacucuccagucuugggggcggggacagcugguuuacgaacagcucaccagccuggcucaucuccugccagcacugcuacuguguuuggguuuagcaucucucccugauuuuucagccauuucuucagaggagcaucuagagcucaaacguuccggcugaguagugggaaccugucgccguaaugggcguuuauggggaugagcauuaacuaagcaccuuuaauaggugucacucaccuggacuccuucaaaaagcgucucauuaguuccugcauguucaaaggagaagcugguccccagagacauauccuucccuccauuccuucuugcagaucccucgaggccaagagcagcgcuguguccagagugccuguucucuggcacuucuaaaaggucagcagagcugucuauaugccaguauuaggagucaccauugaagagcaaugguacaguagucucucucccugugagggagauacuuucaaagaucuguaguagauuccugaaaccauaaauaccaccaaaccugauguaugcugcuaauuccuauaaauacguaucuauaacgaagcuuaauuauaaccagcaauuaacaguaucaauacagcagucauaaaaauacauuguaauaacauguuuuuggcuguaauaaguugccaacacuacucuuuuucccguuugggggucacuguuaaguaaagucagggguacuugaacaacagcacuuguucuacucagaucucuaugacgucgcuagccgaugguuggguauacagccuggauccguugcagaaagggaggacccuuacagagcaggacaacaagauggcuuccuguaacuuccaguggcaggcaacuugaggccaaggaacuacuuuauuucuguaauuuuccauuuaauauuguuaugucauaguugccuucagguaacuagaaccaaggaaagcaaacugugaacaagggagagcuguggcugcagcugcccuucacuugaugugauugucaguaguuuguaaacuggagaguauaucagaucagauagguugugcucuccgggcauugaagaugagcugccucccucacccagggucugucuuagcucauucccugugccugcugcaguuaccccaugaaaugaguccaaacagcaaggugguagccgucacauuccuagucgcuggcaacacacuaaugaagcagagcacaagccacaaccuggacguauuaacugcucgaccaggucuuggacacaugcacccaccugucccuugagacuuuucugugucucugcagcuuaugagagaccucacuuguguagcaccauacaguaagcacggugcuucagcaagcacgugggucacaccgaaccugugaguugaaaugaguccauucucugaacauuacaagaucaccaacuccaaggcggaugggauuccuuccugaucugccauuuacgagccccuagcccuguuuucucauccguauuauggcgcuucccucuuccagguuuucucugcucuauacaguuuaaguuucggggacugacaacagcuuucuguuuaugaauguuccuugcaaugggaguaguguuugauccauaggcuuuaucacaauuggcaauuuuucuaauaacauuucagugaacaguaacuuugaaaggcugaggugccaugcuagcuuuaccucauguugauggaagacugccauucuguuaucuuagucuacagacucauuaagagugguugagguacccauccccccccgcuccccaguugcauuggugaacugggagcuuccguuauguguucucauuaucucccugagcugagcagagggcuaauacaugggguuguggaaauuuuugagcuaauugguuugcgccacuauuccauauuaaucuugccuguuuccuguacuuagacaggcuugccguuuggggggccucgacugagccugaagagauucucguagauuccuagguaguaaagaagcacauaucucagcccccacacuuccuugauuggccucucacacucugcgucaauauucuucuguccuggucucccuagggccacaugccagggaagccguacacuacccaacuucacugccugccaagauaacuugaaccaguccauccucagccuacuuacucugcuucauucauucauuguuagucaacaguguauuacugauuuuaaaaagagaaaucuuaguuaauguccagaguuugguuuugaaguccaaacaucauagugcagcuaugguaaggguugcucuugcucgagucagugacaggaaccugagagcaaguaaacauaagaagcagauguggagagaggucacacuuggcccguuucucuagcccucuugugagaauuaccuuaaucucugaggacaggguacccaguggccuaagaaccuaucaccaggcccaccucuuaaaacuuguaucucccaccugggcgugguggcgcacgccuuuaaucccagcacucaggaggcagagacaggcggauuucugaguucgaggccagccuggucuacaaagugaguuccaggacagccagagcuacacagagaaacccugucuugaaacaaacaaacaaacaagcaaacaaacaaacaaaaaaacccaaaaaacuuguaucucccagcacugauaccuuggggacaacuuucucacacaagaacuccaaagggacacccagacuuucccuguagaaaccgccgugucuuccugacuaacccaguguuuccccauguggccccauacagcagucuuccagugauccgugucuccaucugucugucugucugacuaaauucuucaucugaaaaugcuuugagaauguuacccacugagaaacagguaggaacgauggauacagauugguccugcgcuguuuccagugucugcagagugguggcagacacaucagccucucucacacggauggcuccaugcagagccaguuacaauggauuuggcagcaaauauaguugacuuccaguacagauccagguacuguuuuguaucaaccuagcgcuaaagcccacacacaucagaaaguaccucuugaauguuuggugagguaacugaaguggaucagacggcaaaccaaccguuguccaggaguuuccugacagggagcccccgagugcagagugcuugcuauggaagauccuguggagacgccaugcuuaaacuugaaauugcguuuguguuucaguuccuccuccuggcauaagugauaaaucacuucaacguagcacuguacggugcagccagauucccuuuuccuugcccugugcagcguugcucucuguagccgucuguggucuguuuacauggcucuuuaaacaagaguggaugugcucacagaugacuuucaggggccuuauuagcaucucagccauggagggccuacauuucauuuuaauuaaaagaacaaagcagaaguggaugggagaaaggccauaaaauagaagggaaaggaacccuuuaguagcugacagaagccucuggcugggagagugaucagucugagucuuugaaaaugggaaggcagccuuuuaacaucuuuaauggaaauguuacaaauggcaacccaccacaacucccccaauaaacagagaguaccaccaauaaauaaauaaauaagugcaaaauccaaaaacucaacaccccugccugaguuccucuugcaccuaugugaggaagacaccaaagagccuguuugucaagccauggcugcaaagugauggguucuuuaaauauuuauuuuauguuuauuuauaugcaugcgaauaucucaggguggguauaucuauguguguggaggcccuuggaggccuggggugaacauggaauguugggaaccaaacaugggugcugagaacuaaacucgggccucaacuuaucccagcccacagccccagcagcaggcucucucaucucuccagccccuuaagugcugaaauugaauccuuuaguccagccuguccuuuuuaaccaagaaacacacuugauuaguguuacaaaaacaacuuaaguaauaaagggcuuauuuugacuuagaguuuccauggaauuaaucugggaugcugugguggcaggggcaggaagcuagaugaagcgcuuccuguacuuaggaaguggaguggggugaagaaacaggagagcggacaggaaguggggcccagcuaucagccuccgagucugcacccaguggcuuagcucacuucuuccagcaagacuccaccuccuaaagguuccauaaccuucccaaacugugccagccacggggaccagauguucacaugcaugagccugugugagcauccaguguuggcacuaccacagauacugaaugaaaauaucuguauucacuuuaucucaaauugugaaacugaagauguacacguaaaaugggacuauuuuauuaucuauuuauaauuuuuauuuacuuauguauuuuuuuuuugagacaggagcucacuacauaggccuggcugaccuaaacuugcaguguauaccagacuggccucaaauguggggcaauuguccagccucugccuccugaaugcuaggauuucaaauauuuuaaaaguuaauuaaugacaauuucaaauaaguuugaaaauuagaaaaaaaaauuauagauaucuccagccuaaaacuguauguguguguguguuggauuuuagagccaauaggugcucuucuguucaccagaacgaagaacuuucuagagguggccaaagggcaaucuaaaggcaggugaaugauagcuguccucugaugggaauuauuccugugguagcagccccuuccugauguccuuuccugguggagggcaguggacuugguacagaagagaagaaaggagguguacccccauucucuacagcagggcuucugaaagccacccuuugugugugcuggggcugggcccgugucggacagggcacaaucaggccauuguuucuuugaggaaagcaauggcauccuguugcaauuauuuauggaagaaaauauuugauguuuuuggaggagguuggauguggagggggugaggaagagaaggagggacuuagccagucccacccccuuuagacaucuuggaggaugggacagggccuccaucgagccaccauucuuaaaggcucuacccugucuacuaaacagugcguuaggaggucaugcugggccugggcuccugggguugaagcuggaugucccagugccagcacauguauuccuccagaaggaggaggaguccugcccugcuuucccaccacacacaucauggucugccuuuucaggccacccaagccugauuucucaggcuugccugcuuucucucuuuuccucuuucuuagaagcugccuccuuucuggggugugccuccuuucuggggugccccugacuuauaagccuugcccuuguuggccucaagcaaccagcuagcucucuuugggauucucucagaaauucccaccguuaaccucaaaagcuguuaagcacccgucacguaguaggucucagcauugcaagguuccuguuccauuaucuguauguccugcacaggcucguggccccucauucggccaucuguaucuggacuucccuuugcaaacagccagucauucaaaagcaccugccuggggccaguguagagaaauaacggacaguaauacugacugacgacugcuguuccucaccaguucagagagaccuuccuugcuuuuugccugaauuucccauggcuaacuccagucacucuuaguccccaugccaccuccuuagugaggcaucugugacugcucggcuguacacagcacaaacccacgugccucauaguccuuuacugcuugcuuuuguuuccucuguucagaguugaccucguaaaacuaacuggagcauacccuuaccugcucuguggcuagauaguuaacauuggggaguuccuuggugcuucaucauaucagggugaugcccccauaccuguacuuuaccguaaccuugaaccuuugcugcucccuaaagugaaagaauauaaggaaguacucauucuagauguuacauguaaugauucccuccugcccuggaugggcucuugggaaacuaagguaggcauaaguaugguagcucucuuuggagaagcggcagagggaacugggucauggggcaaagcauguucacagacccccuaccuuuccuuguuuugaguuuaagagauauaagccacacagauuaucuuauccugauucgacaaggggcaagacugagagguuucugcacugggucaaggagaccaguaagcaaagaggguaggcagcuugguuaaugccaaccauggggcuguccucaaaauccaggaaggauggaguaacacagucccuccuggggaggguggcauuuugacuagggguuauuaggggucagcuaauggcaguucagaagagggagggcaagggcugugguguaaguggacugauggccagugaacuggaacuuggcaagguagcaagguugaauguauuaguccaagcuuucacaacaaaguaccacagccuggguggcuuaagcugcugacguuucuuuucucaaaguccuagaacuaugaggccaagaucagaguuccagcaaggucaaauuccagugagguccuuuuucuguguggauggccaucuucucacagcagaguggaugggagagcaagcuucacagcagaguggaugagagagcaagcuuccgugugucuuucaugaaggcaccaaccauuacaaggcucaguuccuccuuacgggcucacuuaaccuucaguuacuaccguagagucugucucuagcagagucaccugagggcuuagggcucugacguaggaauuuggugggaugagaauguaggagcuggccgggggccaguggaguaggcaagggccuacaggccaugacacaagacaaagcacucuagugggucacacucuguauuucugcugauaacuuuaguuguuuucaucgagcagagcaauuaagagugaaaaaucagggaaaacaguuaggaaguuguuuugagaagguuuuuuuggagagauucuacuggcuuggaauagagcucaguuucucaaugccauugacauuuugagcuggacagucuuugaugauaggagcugcugugugcauuauagaaugucuaucaauaucccuggccucuuccugcuagauacuggugguacaucuaccccuugucuaugcaucuuccugcuagauacuggugguacaucuaccccuugucuacgcagacacaauugaaaaauguaucuagacauggcuggaugcagguagugccgggacagaagaguuccuuguugagaacugcacccaucaguuacaguaacuaagaguagauagauucaggaauauuuagggacuugugaaaucuugcagguggggcaaagagggauaaaggaugauucaggcauuuggcuuagaugaaacgagaagugaaguugcccguucccgagcuggcaggaggaagggaguagguuuguuugggaggugugugguggggauggcagauggagcuagaacucugccuugcaucucguuaagucggagaugccucuuugccacucagaggagagcuaagagggacgggggauauagauguauggaauacaggggaugagccaggaguagaggaaagcaugugggacugucugucugaagcauccuucuugggaugagaucacuuugguguuguauucucaggagcccuuggcaccaguaaagccuacagaccauaaucugccaugacuguguuggaaggucaucaagacauuguuuuggggcgaaggggagugauugggccauaaagauugaacccuccugagaaugcuuaguacccuuguaagagagacacagagaauugcccgauaaccuucuaacaaguaaaaucaguccuuuugugcaccaggaaaaugggacuggaacaagacagagacuaccugguugguugguugguugguugguugguugguugguugguugauugguugguuaguugguugguugauggauuugguuacagcaaccaaaauaggugaagacaaaucugaugaauuuuuauuuauauggaauauauccauugauauuuggcccuuaagaaguuaaaacuuuuaaagacuucuucauuuagaagcaaucauagauaugaugugugucauauuuuguuggggaaaaucucuacacgccuggugggagagcaguguggugcuauuuuauuuuugaaaaaaaaaauugcuuucauauuuggcuugcuuggagggcgacuggguguacaucauccacccguacauagccucugacuucuagacaauuucugugugccaucaagagaccacgaaaguuaagaccuaauccuggaacuagaaagguugcugggcuugcuguucuaccaugagggccagaguugugucccagcacccaaguaaggaagcccuugacugccuguagcuccaguuccaagggauaauggaaacaugcggcucguggauguccucuuuuugaaacaacacaauuuaaacagucauuuuagaggagacacuugugaaggccauucugcauugcuuguguuaaaggaacuaugauggguauaaaccaacuuccuccuggcgaugaggaucaucgccuugaaaguagcuucacaacaaggccuggugcucccagauuuucuauccgaguuuauugagcgcccucuuaaaguuaaaaaccauacacuugcugaccuguagugccgguaugaauugggacuuagacuuaaacaccuacaaauucgaagcuuggguaucggcuucuuacacuuguagaccguuuacaacuauaaauugaauacgucuacaugcuaaaugcauguaaaacaguugaaacugaaauauuacuuuaauggcaugagugaugguuggccaaucccaagucacuguuccaaauauaaacugaccuccaagcgaugaguaucuuugagugauggucucugccuucugcauuucaauggguuuuuucccccuuuuaaguaucacagaccuucaguuugaagaguggcaagaucugauuuggacucuacuugaccguuaacauguuuauaugcuuagcguguucccuuucuccucuucccggugcaaaucaggguacaauguuuucuuuccaguguaucuuguucuccaacugcugaugcuaacgucaccuguaagcauucguggaugagaacgcugaggagauacaugcaugagaggauacacaaacagaccacucuuaagaugugcaacauaaagauuagggaggauggcacaggagcaccuccacaggcaagcagugcugugcugugucaguggcuugggaaucacucuucccaauuccugugggguuuuuuuuucccuaacucuaauuuaaucuuuagaccauacacaagaacuacaccugugucacucccagcccuuucucugccccccacuuccaguugcucccaugagcaaacuccaaccucccaaacucaugaccucuuauuuuuaauuauuauccuagcaugugcauguacacacgcauacauaacccacugaguccacgcagcauugccaucuagacaagcgcccagagcugaccacuugagauugggcagccuuugugggagccaguccccggaggacucuucuuuccagcagcccuuacguaccaguagcccccaccuagcgccuaggaucuuguggccucuguuuacuuugucucuagcccugucccucacacuccuggaggucuuacuuguuuguguuugcugccucugucaucuccagcccuguaucagcugcucucgaucgacuguguuucgggaauauaaauauuuauucuugggcaaaguguauacaagucgaugcuaaguagucugugaauuggaugagugauacgcagucacaaaggcauagucacugcuagucacugcagcugcugcuuugcuccgagguggaguuggaacuucuucuggagacaggagaggaaggaaaacuggcuugcuagguacucggaugaggaagaggucggaugugugcucugaagugcucuccaggucuucgugugcaguuuggcuucucuugcacugaugaugauacuaagguggauagccuugguuagcaaugcaaauagaacuguuagggggggggggcucuaagccauuagcugacaucugagaggaccaagauugcuugauuugacaccuguagagagcuuuaguuauagauacucggccuacagagccaagacaugacucgugaaagagcgguagggaacggucaugugugcauuuacacgggcucacaugcgugugggucuguauuccagcuccaggcaacccagucuccuccacaagcgauuauaccguggaggguuuaugaagugcugaaacauaugcagaguaugcugccaauaggagcugcuuuauaaaugauaaauaauaguugacuuggcagaacacaucaguugagauuacaagaaaauagaugguaggucuccaggaaacuuucccugccugugcagggucugucugucguacagcccuugagccacccugauaguuaccuagugaacgcuccuugggcagagccugcuguguguuugcaagguguguagcccuggcccugccucacaggccugggcagaguucugagucuauacacuguuucguguugccucuggcaagaaccaaugaguguaggguuggagucaugggcacacuuuaggcuugaguuggcuuugugugcuugguuaaugccacugcauuucuacagaauaaaguucaaccauaaaaguuuccugucaagagccaaguaaggaugagagagcuuaaacaugcauuucaacccacugauacuagaaacuggugugcuuugugccuggaagcaacagggucucuaaccaguuggugugaaaaguccauuuucaucugucuacucgcccauccagucauucucucccaugaggaagccuuuuuccuuuguguugaggaaauggccccguuccuaacauguuugccaugcuagguggaggauccgaguucagaccaugagcggccauguucuuagaggcucagcaugauugcguguaaucuuaguacagaggagggcagaaacgggcugauccauggagcucgcuggccacuuggugaucucuagguugagcugcaaaauugagagacaggcacaguagaagagcuggauacagacccacaggugccaugaaugugugcacauaucaacaggcgaacacacaugacacuguaaugcuuuuuugaaguuaguuuauucucugguaacuuauugugugaagaugaaaaaaaucagaauaauugacuuucaccaucagaaaggggguuacuguagguucuagaggucacguugcuuaaugcagaaauaguaguuaggugacaugaauuaagacuaauugcucgaggaaagaagagugcgcuugacuaaauuagaaauguuuucugcauuuuuuuuuuuuuuuuuggaaguacaagugcuuuaaaugagguuccagcguaagcucgcaugcgguuuccauuuuauaguuuucuuacccaauugaaaacaaacucucagggauuuuauugaacuuggucaguugggaccuacccaaggccgaaccgccaccuucuacuggguucccaaucucccucucccgcugcgagggaagcagcacacccgggcgcuguugacagagcccuuuaugucaccaguucccggcuuacaaacuaggcuaggagacacaaaagacacuuggcacuucaugacuaccuaagacuggcuucuuucucuucuaaagugacuuggccaggauuggccucaagucccccgaaaaaggaggagacugaaaugcaaacagaguugaauaauaaagugaugucauugugaaccaauuggaacaguuggugucacgugccuggcagccacuucaaaugcccacagaauaaggguaauggcuuaagucauguuucuucccucacccuaagccugagcaguccaggggaccagaugcagaaugcagaauagccucuauagccagcuuaguugugcuuggaggaugcaucuuaacaaguugguugguuuuuguaaauuauuaugacaaauucaaaacuuauuuucugguucugcccuaccaauacagccaaaaucauuucuaacucacugaaaagcggaaguagacuccaguuucccuuugaagucgcagucuacaaagcuggcccguggcacauuuccaggugugucaggcggugcuuuucagcuaacauuacauucacugggcuucacaaccaggacgucuuggauucguuauuacaaagauugcugcguggccaccacacgcuuguuuaugauccaguaguuaaaaucuuuccagaaaauguuuuuuucucucuggaccacccugcuugaaauaacaagacaaccaccguacaaaacaaacucaguuaccuacuauuuucaagcauauugugggguagaggccgaggagaauggaggaagugggggagggcagaugagagcagacuggaaguguuugcuucuagagucagacuugucaaucucuuuaucagucucucauuugugagugauguaguucaaacaauacuaaaacaagcaucaguugucuccuuuuaaaagcaaaacaacaacaaaauauuucuugcauaaccagcuuugggagccaggguagguaaccugagaguauugagugauuuuuuuuuuuucugggcugacugcagcccauuuaggaguaguccguauugauagagcugccagcucuccucagguagaagagagccacugccuuugugcccacccuccuagcuucucugccuccuucccggugaauaucaaguggcuaguguaacuaggcccccucagaaggaauucuccccccugacaucucuggucuucugcaagggcccuuuguguuagucacuuggucagcacagaagccucugccuuaaugcagcccucugcuuggucuccuccauuacaaccugucuuucugucuaucccccgcuuccugcucuagaucacggcuugguuguuguguccgccccgcuaaguuaugauucucaccuguuggcuguaauucacaauggcucccuagugucuguaaugugaugucuuaacuguagguuauccccaccggauaccuaagcuugucugcggcugcuccacggaaguguagaccuuggacuggguuucugauccuucugccaagaugcucaauccuugucucccacucucaugccuucuugcaccugaaagaaauuccuucgcgugauuuccccccuugacugucacuccccagcuaagagcuggguuuuuuuuuuuucucccuaaguacucgguugugguugucugcauucucucuacuaaaacuugaucuuguacuguauuguuuuguucuuucauuucacaaacuugucauagccgaggggauuccaaauugauauaguaugccaguccacucugugucucugaggcuggagcaaauccuguuguugauuguguggccucaauggcccugcaccuuguuucccaccgccuuuccaaugagaugauggucuugauuucucaagaacaccauagaggcucuguguuugcggugucugccaggacagucauuguccuuaaacuagcugauggugacagaaguacagucagcacccugaaaucaauguggucccaauccuaccccaagucuugaaaacuaaauacuacaggagguuaggaaauacuugcugagccuaauaccugugugaaauauauagauauaacccaaauauuuuagaacaugaaaauauuguuguggcuuacucagggguuguugcuaaacucggacaagagggaaugauacaaugugugagcugcguucuuccugggagccugugugugcccuguccguguugcaaguuaaauuaaagauuuugaaaagcaauguaaaaaugauuuaccgcuccguaauugguuuccugaaagccaaaugauauuuaugugaacaaccaugaaagaugcagcuacuguaauuuaucgugcuagaguauuuucaaaauguauggaaugacuaaagcguaaguguauuaaauauucuagaggaagacauauuuaggccauaaaucuaggcuccccuuggaauuuguauuccuucuucugugccagguagaugaagauuuuuaaguuuuuaggccuccgugggaggaagauuuaggguuuggggaguacauuuguaucuccuuuaaauuucuauuguuuaucaguggcauguauaaauguuuuagggaaguguugacugcaacauuacccacuuuagcucugcccaauugucuggcaacuaugggguaaagauggaaggaagugcuguauuuuccugugacagguguaucucagaagugcucaggcaccugggcaggcaauaaaauauuaaggguuguucccagagcaguuugcccugcuugaugugugaacauauaugggguuuauaauuggccuggccauaugguugccuaggauuagacucuucauaucccacuaaacccucuucuuagaagcaagaacauggagagaauuuauuuuaaaauguaauugcuguguuacugagauuugaauuugaguacucagaauaaacugcauuucuguuuagaggcugguugcgcgaaaauuuucagucauaaccacuccccaucagagaaggaauaauaagugcaacagcagagguccaugucauuucgagaguuguggugaggaguugauucagggcaaauagcucaugggaaacaugcagaaagcuuggagucacuggucggaucugaaugcauucagacgggagucacguguauauacuuuggcgauuccuucaguucugauguuuuuguucuguuuagaugauguuugguucucagugaaccagagaggauaugggagagagaagagagccgagaguccucagugucauucuauugcuuacaagcaggaaucuaggcagcccucagacuugguaauucaggguauuuggagauagugugaauuagcuuuaaaaggccacuuaacacagauggaagagucauucuuacuuagcugauuuaacauggccacuaaaagugcuaggagcgaucagagaagcauuucuuaccacggguucugcaugcaguucagaguuaaaaggugcagagaaaugcuuucuggaucccccaugccaccugcugaaaucugauugggcagucagauguggacgguucccuguuggaagcaacggugaggauacaggauggagcugauaugggaaagcagggcucucugaaaugcccacuggaagaccagcccaguguauccuaaggagugaguuccuccuugcuauggacaugacaguuaacuuugacugcguuuuaagaucucucaaaauacugggguuauauugaaccuuuguagcucuaccuugggaugcacguuugagagcaguucuuuggugucauuuaguucaccuguagccagaaauguacuaggagaugcagagagcccucugcccacuugacauguuaacacuggcccugccccuguaacggucagcuagguggagcagaugcugggugcauacagaagggagacaaagagauuucauuugugaaucugaccuccuguguuucucagguuuguaguagaguggcuuuugaaaaucguggagaauaauaggggagaugaaaugggcucagaaagauugaggcuucuucaccucuccucucacgugcccauaagcuucaugguggccacucuugucaggcaaucucuguaccccaaacauuuugcaaagaaauuaauguucuguaaagaaaaaaacaaaaaugaauaauacccacuguuuaaaggaaaucuuaggcaaagguuuuucuaauacauauuuacccuaauguguuuuguguguguguguguuagagagagagagaaaaugagugugugugugugugugugugucuauaugaucuggcgguuuuagggugguuuuguuugucuaaaccuaggguaugccuaauauuugcuauuuaguguauuuuguaauuaccucagugccuugaaaagucaacccaguucacuuaaauuccuuugaaccuuuuauaugauuugaugcucuucgaacuaguacuugagaacgacuacuuuuaagcucucagacgcacuuaguuucaguuguuggccuaauugcacaauauuuuuacucauuuagacaagucccuaagggcuuuugggauaguggcccuuguuguaaguccuuccaacuagaaaaacuucauuaauugaaaaauaaucuccaauucacacuagguucaaaaugagucauuuuuaccaagcauggcuuaaagaauuuguuugcaguuuuugugugugaugcuagguacagaaucccagggccccucacacaccagucaagaguguguucccacuccgcuacacuuccuuauccugagaggucggucgguggguuuguuuuguuauuugagugacauuucacggaguggcagaaguguuugcuccuuccuuccucccggcaggcguuucugcauuauccucaucugagcuagcaugcaguugagugacuguagcccuaagcucauugaacugcucagcacuuucccauguuuacaacuguaaaauaauaauaauuauaaugaugcacccccuucuuauuauucagguaucauacaaaugugucguugucaugcuuaaggguuagauaugucugcuacguuguuuguuugagacguguugugauucugcaacgcagccuaucuuggagcucacuuuauagucccugcuggcuucgaacucaagacagcccuccugccuuuccccuuugagugcugggauugcaggcaugagccauccuuccugguucaacuaugugacucuuaaggggaaagaacugcacucguugguccauggaggcaggagaaucgggagcucaaggucauucucagucacacauaaaauacuaggccagccugggcuaccugagaccuugucuccagaaaagaaaaaggggaaaggaaaaaaaagaacuaauguauuuuaaaguuggagaacagccuuagaccugcaguggacugaugucuacuuuucauuuuguaaaauauuuugaacauuucuauuuagcauucauaaugcucuaaauagaagcagaacacuguagcucucagauccugggacaggcaggucaugagggcucugacuguuuggggacagucugugacucuugauguuuuaaauguagcaauuauggccuugaaaaacuguaacucuaauauuggcauuuguuggucaucucagaugaacccaaacugaccauugcuguguuugggugaaaccugaugcuuuugcuuuuuuuucucuguuugcuuuuuucucuaucauaaaaguauuuaauuauaaaaauaagugcuuuucagauuuccaccuucaauauauugacuguggguuucugaugcagcaucagacuggagcagccuguccuuugaggcccaguguuuccauggccuggaaggacccucuccugccgucaguaacuucuguagcuucuuuccuccuagauguucuucccuguccaccagugaccaccacuaccucuuccccuucuccuccuccuccuccuccccccucccccuucuccagauuucagguucccgaagaacgagggagccagaacucaucaucuucauggcuugccuuaccagguauagccauaaguccauuugguaccugcuguccacugaacuugaccugguuuugccccaccugugucuccacaagauguaugguuuugggaaauggcccugucaucuuauacuuaagacaaugaauaggguuuucaaagacagcaugcauucugguaucuuucaauguuauguuuauuuauuugguugcucuauguguggacgugccauagcacacguguggagauagagccuggaaugugacuccugaagauugaagucagagcaagcacccuuccucacucagccaucuaacuagcccugcuuucuggucuuuguaguugacacguuguccucaguuccacuaaguuucccauggaguuaauucugccaacucuuuucuacguaaaugcucccuuauuuaaguuccacccucauucucccucaugguugcuauggguuccuaaauccacuuccugugucuaccuccugccuacccagcaucaucucaccugcugggagacagcuccuugcgucaucucugcugugacauaauggagcucgcuguuagccauuuucaaaccccacaucccugacccaccuucuaugagaucugcaccccuugcacuggaaucugccauccacauuuucaucucaauaacauucucucuucucucugcugaaaauagucuucacugccuucuccauguuucuggcucccuuucuucagacucuuaagaaauugcucuugucaaccccacucuggcccuuuagucuuuaacuugaugcacaaguucugugugcccagggaucuuauaaacuucuaaagggcaagacagggauugugucuacacuacugagggacagacaugugucuuaacacauuccugcagcccagcagugaucaugcaugcaggaguugugcugucuuauuccauauggggucugcaguguguucuaggagucaguuacauaauucagugaaugacuuagaagaaagagaggaaaggaaggaaaauuuguaaaacugaccauuucaaguuccucauaggucagguuuuuaaaaugucaggccggacauuuuguuucuacuuuaaaaaaaaaaaacuggagaagcugaagauacuacuaguaugaacguauguugagucaucucagugacuguaaauuaacugcagaucucgauugccuuucuuaagugcauaguugucucuagaaaagcaaaggcaaguuaguuggggugucaauggaggcuuuccacaccuuccuauuuucccuugaaacacaagguuguuauuuaagcuggacuauaggaauuggcuuccuagguuguugaccuacagggucuaccagagggccugauguuauuauguaagccacaauuuagaaggccagguaccuucaaaccuuccuguagguuucguucagaucugguguugaccagaggaaguggggagcuaauagugggauugcgugguacaguggaacacacuaggaagucagccuaccuucccaagugcucuaagcucauuugguuccccucuacuuuacucuuugcaucugccaaacaaagcagcaaacuccauuuccccucuauggaaaauauggcugguugagccauacagugugauagagcuugccuauguugucugucagggcugucauggagcacaaaagguggcucaguguucuguuaacuugacugguucauuggguuccagugguugaguuugguggaugcccuguugugguuucaccucagaaggaguuugcagguugguagcuuccuaagaccuaggaagcugcuaggaugcaguacagcccuucaguacccuggaguucugcagauguagguccagccagugccauacuuacaaugggauucuagcugagcauggugccacacaccuuccauucccagcauuugagaagcagcguuaggaagguugagaaccacugcucuaagcagugccguacgguugacuguuuacgcagcguuugugcgcucucaaguauggcaaaccaucuagcucugauuucuaguaugcaggaagaaaaacuuaaaucauaugcagauuuaccaucuauaauaagaaacuugcucaucucagauuuucaugucugagggagggaucuugaacccaucccccauggauacugagagcugacuauuugucaucugccguuuuauggaaaugacucuucagaugauaaugcauucauaauuucauguggaugacuugacaauguuucuguauuuucaaugucccauugauaaauguagucuaacccccccccaaaaaauuauggagauauuaagaagguaggccccgccccacaccuuucaguuccaaaaguauccucggggcaauuacaagcuguuaggaguaucacacacuaguaacacggcggauacccaagcuuacagcacagaagucauuaaucaugccugcucuugacagggagacuguuuucuagguuuuaaaaaagaaaaucuuaaaagcuuaugcuguuuuguuuguuuguuuuuuuuauuaaggaguaauuuggagccaguaacuuaaccuguuuuucauaaaugugcuagcuagaggcagccaaaaaaaacaaaacaacaaaucucugcuuucagaguuaggguccuuauaugaacuucuguguaggaucaugauaacucuaguaacugccugaguuagucuuucugaguuuaguacagacccugauauaggauuugauuuacauggcccagcccugcucuucugaagucuucuaauuaaaaccugucaccauacuuacuguucaaccuguccccaagaaacaaaccauuuguuuccuuugcauaucaugguuuuguguuugagucgugcguuuagagcucgagacuuugccuuugaaaagaguguauauagccucaacuccuaucuuuguauccccacuaucacuacaaucccuggcacacaguaggaccucagaaauauuuaugguagaaauauccagaggaaucacucuggcugcucuugacaguuaucaccugugucuaaggcgaaaugcucuuaggaaaauggaagccaucaaacacuucagcuucaauaaugugcuuuuuccuguuuaugagaguuuucucaucaaagaaucauguuccagcuaaaacaaaacaacucuugucuuuacgcuuacuucagcuuuauuuucucuuacucagcauuuuaacuccaccagaauugauauaucgguucaauaagacuugagccgucuggggaccaauuguguaggaaagacauggaacucuuuagguuaccagaaaucccaggaguuagagucucuuucuccauuguggauucaugugacugcucaaagagaggaggccucaccaaaugaaccauuuaccuaagggcccuuugcccuuuaaacugaaaggguuuuaguuggagaugguauuuggggcaccccauaagguagcugguauaaaccuagcaguuaagaaggagucaaccucuacuucugcacacaugcauuuacuugggcucaaucugcuaaugaugguuuggguugagaauuugguucagagguuagaggucaugaccgucuagauacccagauacuugccuguguuuaugagggacaggauugaucuguucaccagguuuauauugaucuaaaaaucacauccuguguuacaauaacugcagacauuuuagauggccaggaggagagaccacgccgcacacugacugagcugccagggaagagcagcguaguaacugguaggcugauagggcaggacccgacaaguagccagccuuccccacucuggagacuauacacaccccaugcaccccaguucugacuuggagcuauuauucuaccgagcccauuggaacauuuuccaaguaguuuuucaguuuggcaauaagauagguaggaacccauccauagcugauacaagcaaagugugaguacacaucuuuuuuucauuacugcacuuucuacagaaggcuuggaggauggggaaagggaugauuuuaaggaacaauuuucucuuuaaugauuucuuucuccguacaaaggaaaaggacugaagguguagggucagugaaagccaggcaaacacaagaaguucacguaaguucaguccacagccccguugagagagagagagaaacagagaauaugaauuucuauaccgaggaaggacccaaacaaccaagaguaaauguuuugcaacuuaaggaaguuaaguuuagggaacaggaugaucaaagagccggaacagucgcagucccuguagacgagauguugccguacucuguagacagaagaagucuagagcaagucugagcagcuucagaccuggcugcuuucuggaaagaaagcuguuccacaaaaccucuggaaccagcuccuauagagcaaaggaugacaucauuccuuaggacgcuaaaaguugguuccaacuacaucuucuagagaaccacacagcuguguugucaaggguggugcacaaauggggggagugugugauguggaccuuuguggaagaauaauguguuuauaaauuugaaguuuguucucugucucucucugucuaucugucugucucucucucuuucucucucuaaucuccaaugacauugugacuucacucaucuucugucucaccugaguaacauccgauuccccaaaaguuaugaagacauggagggagcaaaaucggaagagcuguaacacaagccagcucuguaguauaaugacccuacuuaccagggacaaagugacaaagcaaacuaaagaguaagccagccucccaggcucucugcuuccuccucagcuucauuuaaaaaaaaaaaaaaaaaccuuagaaaaaguugaaaacggcacagagaguuccugaaaugucacccagcucuccucauguuaacaucuuacauaaucauaauccaguuaucacaaccaagacacuaacauuggcacaauauucuuagcaggcuuuauuuaaauuccaccaguuuucccacuaacgugcuuucuuucauucccaagucuuuggucguguggaugugucuuaucuguguggucuucucgaggcugugaugggucugcuugucuugcugauuuugcaugguguugucacuuuuaacgagcacucauccuaugaccccauaaccugcucuuaaacuggggucucucgugacauuagguuugugcauuugagugauuaacuccuucaggaaggguauacagugcccucggugugucacugugcccaggguggcaccaguacaucugugauggguggcguuacucuugauuacuuggaugagauguuaugucugagccuucacugucccaugcuuacugaugacuucagagguaagacuuggagcuuaccagccccagcuacuuauugcgaugccccagaggcaguuucguauuucucugguuguuucugaaaggaaggugguacccuugcuuaaguuugaacauucauucacauggcacacuauucuccagauaacuuuguaggagacugaaagugacuuugaaacaauggagaugucuuugucauggugaaagaaugacccuggguaugucuucaucaccuggccuggagacagagugucccccucccccccccccccaguucuaaauuggaucuguccuauuccugagccccuuggagcauuauccaaauaguuuccauagucggcaagucuucugacauggcuuauucauugaucuuacacaaacaucuuagacaguaggggacuguuaaugaauaggugugggauucaccuuuauuggaaagaauuuugauuuugugauuucagccuuuucauuaucugccacuagccauuuauuauaugcugcccagacuuggauuuacuuugccugcagcuuucuguaagugaccauccuugggaaagggugcuuaugagccucucagagagaggguugucagaucagugcgggaagugacauguaucucuuugaggcugcacaagggguacaaguuagagauuagaaacauauggagguuaacccggcugguugggagggauuccuaagcguaucugcagauuucaguuagccgggccccucagacuuuccaguggcuggcuguccugaaacgggagagaagaggcaaguuacacauccugcauggugauaugguuacugauacacucuugaugcauaacuguuagaaggaugagaugaagacagaguccuggucagggaugguggccacuguagcugcauccagaaagaugaaaguugaaaugccuguuuugcauccugcaugaaaauuaacacaugcuacuaagaucccuuugcucugcuucuggcuucacuguugaagaugcuaucuggagugucaguaacuaaaauuauuccaagauucauugggauugggauaacuagggaguagaagcaggagagaugcuuguguuugcuuucuugaauucuucacuuuucuaagagcugggcacaccuucugcgugacagucacaucuccgccccuugcuuuugcccaucagauucccccacccccacuccccaccagcacagugagggcaaagggcguugagaggcagacucaucugagcagaguguucccuucgcuccgcucaucccuguuuguucauggaucccagugcccagagcaucccuguagagccucagaagugggacagaggacaacuuaaauaaguuuccagccaagaagcagcuggcugcaacuucaggggaggugcugggcucccuugucgccgccugaggcggucuccuccugccccuccacucuccucuugugacgacucagcugauccuggaaaaauacaaguauccuccuuagugaccgugggagaagagggacucuuucuugcuggaaaaguuuccgucccugcagucuccacucaacuccaacucucgccaaggccaccgggacuggagcgcucacgaagccaugaacgaacggcauuaucagccaaguuauaguucguuagccuuccaggaagccuuugccuggauugcagugauagccagcacguagggccuugcuguaugcugagcuucccauauacaaacucagucuucacauagauacaguuacacuccagcucuaaccuacuuuagagcuaagugcucccagaugccgguaguaguuguagggggcacgggugcagcagcauugguucugggugccccauuaaugaaacaucuggaaagcuccagcuucauuuauucauuaaagggacuccuugcuaccaaccccggggugcuggauacccaaaguagcuuucaguaggaaccucuacccacccacccugcuucugcagcagagaccuccucuaaagcaacaagaagagugcacacuccccaguccuccgugagaggacugaggcugagguauuugcagguuuuagaguagaugccugugugcucaaauggucuuucauucugcauuucauuuugcaaacaauuuacuccccccuucccugaccuguuccugcugcugcccgucacccagacuuccaaaccacauuauugcaucucgugguuaccuuugacaggucugauucugaaaaccccauuuuucacuaggcuuugagauaguccuugugauuaacuuuuuaccucuguaagucacugccccucguaauuuuaauuacaugguccauuccuuuucuucuucuucuaagauaauuuugcuuuugcaguuggggugggucauugagccuucucuucuugacuggagccauucuaggaggauguaaugaacgaguaucauaacucaugaugugaagaucuuugaggggagaaacuggaaaagaaaaacaaacaaacaaaaacaaacaacaacaacaaaaacccaguauguucuaccugccuuagagcuugcaugcugugguggccaagucagguuuuuauaguaugcuauuccuucagaugucaccuaagccugugguagacugaguaagugagcuaacauuaggauggagugggagcgugggagugaggaugguaccggaggcccugcugugucauuaggucauuugcagugugagagugugagcuaaaaaacagucuuaccgccaugaugagcuuucaguuccauuucuacagggcacggggaaagccauuuccuaugcccccuagagcugugcgccaagacuucgauggugugguggguugcaccuguaguuccaagaguaguuggaacccaacuugauuaauacagcaaguugaagauuagucaggaguacaguuagacccuaccuaagagaggcaguggcaaacaacaguuucacugucuccaccaggguaaguuucccuccccauacccaaccccuggcccccgccccaccuucucccucucuucuucacccccuucuuuuguuuuuguuuguuuguguuguuuuuugaggcagggucucucuauacagccccugcuguccuggaacucacuguguaaagcagacuggccucaaauucacagggacccgccugccucugccucuaccucugcaccuccuggauuuuuguguugguuuguuuuuuacuuuuccugacaggacagucuccagcagcaaguucagcucuggaccacacacgguguuugucuccugcaccuacaccuugucuccuggcuccugguguguucccccuugcugaugucaggaaggagguggaguugcuagucuugacuagagauucugccagcauccaacaauacacugccagcggagugucuucagacuauagaaacaacgugcggaaacaucugcagagugcgcuggagaggcaagccgccuugccaugagcaggaguuggcuugccucucucuaguccugcucccugggcauggccgcugcuuuuucucgacaucuagaggauuccgucccccauugcguggcauuuuuuugucuucaucugcuccuugaaaaguucugaacaggggcuucuaccuugcuagcuuccccagcaaaggugcauuuugucacuuggaaacaagccacuuuuggcauccucucucuagauuaucuccucccuccagcucccuuagaagggguuuuucucuguguuguuuugcuuuuguuucauccaucucuguagagagaaguagaacucuggacuagaauacaugaacaaggauggccucucuggaaaguuccagaacguguuucuucugcucuguuccuugagugacgugguguagaagcgagguaggccucauaccugccaaguccgcacaacccaagcuuggcagcccuccccguauuacccugcugucuuugauaaggaaagggcauccauauuaaagcugguuuuacucccaggggcuaacagaaaagcaaucuauugucccauggagguaaaagcuguacuccucaguagggucauugugccugccuccuguugcuuuggggggacugagggaguguuuauaaaaacaaaccuguaaaguagagacaaaaaggcuuuucccccucagcuuagccuuucaaguuaagguacucacuuugccugacaauaauaaaauggagaguuguaauuagaaaagguuggugcaguugguacgccaacaaucauuauuuaagacuuguuuggccuuuccuuuuuuggucagucaugcaauuauuucuguugaagcacaaaccagaaccaucaguuaaaggcuaaaucagggcucaggaaaugcucacugugcuucggcagagcaagacaaaggcccuuguucucuagguccucucucucucucucucucucucucucucucucucucucucucucucucccucucugucucucucucucucucucucucucucucucucucucucucugugugucugugugugugcgcgugcacacacgcacgcacgcacaucaggacaacuuugucauuaaagucuuucagcauaaaucaggcuuguuuuuauggaagugcagcaggaucuaagcgcucugccuugagccugagcgucuagaguggaaauagagucauaaaggcacuugcaccuuacuucuucgugcaggaugaguauuuguagaaaauguuucagaaugcagucgcagucccacucuguuccuuuagcaacugguaguauccggagcgucgccaauaagacuucaaguuguguuugcaucaucaggcuugguaugggacuuugaaaguugugaguuugagucucuucucucagcacaccggugguggguguucagcuugcuuguugaugcguauguauugugucaguuuuggcuguugaaagugcuccaaaggaggccgggcuguagcuuagcuggcagugaguuguuagagugcuucucuggggugcguggaggcccugggauccaguacaacagaagcgguggaagggacugggucagcuguuaaaagucaucuucggcuacauacggguuagccugggauacaagagaccuugucaaagaaaagguuggagugcuccucuuguuuuuaaccuaagacaccaucugagagucuuacugcuauuuaguuucaugcugaauguuuucauuaaauuuguuaaaaacaaauuugguuauguauauaaguaucuuagaaaauaauuuauauauucaauauaaauggaguggacaagaacuauaaacugcacucuguucuucauacugaggaaaccgcagagauuauaagaauaaauggcacagggcuguuuuucuuuguuuuuguuucuuucuugauuuacauuuugucaguuugugugugugugugugugugugugugugugugugugugugugugggcagaugaccgugaaggcuagcucuccuaaaacuaacucuguagaccaggcuggccucaaacuccaagagaaccucugccucugccuucuaagugcuaggacuaaaggcaugcaccaccaugcccagccuuuuucuuugucuuuuaacugaccuagugaacaagagggaagaaggaaaacaugaccauuaacaacuuccuugacuuccagugggcgcccaagaugaaauucucugcugauccugagaggguuuagagauuuguuguuguuugugguccccagucccgucccgucucccccccccccccaauaaguaaaaaaucuuuuacucaacacuugcuggagaagaaacuccagucugggccuggaguccuguucuugucagugguccgcuuuccccuggggugaagggccccauucugcagccgcugaggcacuaggccugcaggaaugccugcgaaccgaggacucagugcucugcuccucuuuguuuguuuguuuucagagcagauggguuuguuugcuuuucgcuuaaacauuaaucaaaaaucaauuucuggcuauguaaguggcauuagauaauucucauucuggcuacaguaaauaauaucuauuuguucauguuagauaagucuagcuagugguaaaauguaaaauagaauuacaugagauaugacauacagcuauguguuuuauaaauuaaugcuuuuaugcaugugggaggagaagcaauuuaacuuacugacaaaaggaaaagcaagggagauuccaagagaaaggagaggauaccaaaugcaaacaaauugggacgauaaagggaagacgguaauuuaguccaaucuuuccaguaaaucguuacaguaaguuggggaaagaagcauuaggaaggaauauuguaagcccugaacauguuuauauccucucagugcuuuccuagcccuacuguguucaggagggauguagcaugucacauaguugaggguauuaucccuggugcagaugggaugucugcuuguaaauaaacugccagaauucauuguguguguggaaacauaacuaccauuuucaugaagccaaaauagaaguuuacguccugcuaaguauuuguguaucuguacgugugucuauagagagucuuaauuguuacgauuugaaauacacagagaaagcaggaaguuaacuaaaagugccguacguguuucucccuuucguagauuuagaucugcuaauugcaaaaaaaaaaaaaaaaaaaaaaagccuguuuuuaaaucaaucaacgggaacuuuuuauggcuuuucuuaagacucguuuagcuuugaaaaggccaaaaguuuaaugaagcuucuacaugccaaucuccuuuuccuucuccuagagaaugugcuucaacuguaauugcguuugcauuguuuaaaauacuagugauuccacagcaaaccucugagguagcugagacacagaagcaaagccgaaggauccacgugucucggccuggcgccauggcgcccaccguguagcuccagucgguguccugggucuguuccuuucucaguaaguccagaaggauuuggccagccccucaaacuugguaaacucugaagucugcacagucaauguucaauaacacugaggguaagaauaaauauaaagaaguuaaaaaucuagacacuuaagcccagcugguugauguaugucuuuaaucccagcacuccagaugaagaagcaaaaggguccccacgcgucaggggucagccuggucuacauaacuaguucuaggauagccagggcuacguagagagaccaugucucaaaacaaggggaaaaaaguguauuuagacacauauuuaagcggaauuuauaaaauuaaguaguagaaauuuaagucgguguguuuuauuuacaaaacaggcauuucaacuuuuccuaagaauugugcuaugggcuuuauucuuuguugaccccgauacaggaacacaucugucauggcggccuuugaggcccuucuaugcauacagucuggaaaguguucucuuuuccuccccacugccccgcugauauuccugcauuuuucucuaagguuuuguuguccaugagccaucuguuugcaguugguugacaagguuuuguucucccaugucacaagcauugauugcauauguccguuuuccgaaugccauacccagugguccugauagcaaauuacagugguuagugcucagggcuccaacucacaaugccugugaguguuucaaaguagcugcugcuauuacuguuguugucaucaucaucaucuaagcuccuauuucauaguagauauagugaauauuaaaagcacccuaauggacuacaaauuuuuuuuacuacacaauugaguugcagccucacaaaaccaaaaguuggagauaugagccuaaugaaaacucgacauuaguggcagcucccaacugccuucucugcauugucacaagacaucauaugcugcucacacuauuucuacuccaccuuuugcuucucgaaaagaaaugucaauuuuuccaaggagucucuguuaucagccaacagaaagauucuuugacucuguacauuucuuuuuaacccugaaaucaaaauuuacuccucaaaaugcuuuauaacauuuuuuagcuuaggccaguuugcauaaggcaugcauaaaaaaacagaucucuccgugugcugacagugcguuuguacuuugggguuuugaacuccuaaggucuuccuuaauucccccaugcuucagcuagcugcuucuccaguaguuacuaaagggaucauuggauacacuaauguuuuucugaguaguggccagggugcagguacaagagugacucuccuaaauugagaaguaauaaauggauucagagagaaaucgggguuaggcauaauuguucuuuacugcccugucuuucagugcaaccgcauuggggagaaucuuaucuucccauagcuccugagaacuugagugacuccugccaguucuuuagcaaugcuucgaggaauggcccagucucugauucuguaaacugggcuucucagagguuucuguguggaacaggagagcauucgguacuuagggauucaguucggggaacagcagaggcuaacuaguggaagauggugguguugggagcuuucuaaccaagauucugcaagcacagggacuguggccaugcuugucaucaucagagcaaagguguuuacucgaggagcuccuugaggacagauaugugugacuguguuguuguuacuagccaggcacuucccuaugccgacuaugaccucagcccaagaggucauagguuaagaggucuggaaugagaccaaggcugggcagcucugcucugauauuuaugcugggaccucuugguuuguaagaugauauuuuaguuacguuugucuguugagacaugguugcacuauuuauuccaagcuagucugaaguuaagacccuucuuccaugagcccucuuguucugggauuauugacaccaccacauacagcugguuguuuaauguucauaaagggacauaccuuuaaacacacagcucugaaacaggaaacuugguuuuaucucauaaaacguucagcagaacaucauggcuaucacguguaugaaugagcucaucagacaugaaugagcucaucuguauguccagcucugugggguuucucugguauagauagaugcauagcugcuauaguagccuagcugagauacuuuccuaaggcaugcacuaaggcacgcaguuagcuuuccaccucacccacacugccccaagcccucagucuuguucucccaacacuuuccacucuuggguuagaagcuccccauauccagucuugccucuaccagcuagugcuaugcccuacaucugaauugcuuacguuguaaaugucaagucaaaauuuauugguuugaauugaguugauuagaaccuugguauuuuagcccaaaaguugaggauacccaagauacaauucauaggccacaugaagcucaagaagaaggaagaccaaaguaugagugcuuugguccuucuuaguaagugguacaaaguacucaccgggacaaauguggagacagaguguggagcagagacugaaagaaaggccauccaaagacugccccaccuggggauccaucccauauacaaucaccaaacccagacacuauuguggaugccaaaaaguacuuucugccagagccugacaaauacagagguggaugcucgcagccaaccauuggacugaacaugugguccccaaugaggguccccaguggaggaguuagaaaaaagacugaaggaacugaagggguuugcaaccccauugaaagaacaaugacaucaagcaaccagaccccccagagcucccaaggacuaaaccaccaauacauggagggacccauggcucaagucacacauagcagaggaugaccugguugggcaucaaugggaggagaggaccuugguccugugaaggcucaauaccccagucuaggggaaugccaggccaccaggcaggagugagugggugggggaacacccucauagaagcagggggaggagggaugggacagaggguuuuugggagagcaggaaaggggacaacauuugaaauguaaauaaagaaaauauccaauaaaaaaaaauaauaaacuucauacuagugaggggaaaagaccuuuggugucguuuauuuauugagaguucuaagagcacagggaacuuggcaaauagcuccaucaauggcaugauugccacacaaauguggggaacugacuucaagucgaagaaucuaucuuaaaaaucacgggcacaguggcacaagcuugaaaucuccguuauguagaaacagagguagacagaccccuggggcuuguggccagccacuuguuugcuucauuggugugcuacagcccagcaagagaaccugucugaaauaggguggagggaggaacagcacccagaguugcccuguggguucacacaugugcauacaugcucagauucuaagggcauggaauuaagcaucuucuggaaauaacauaagccagacuuagucaugugauaacgcuacagugugcaaauaauuugcuauacaacaucauagaagaaaaguuuuucccagagaaaaaugcuuaaaaauuaauaagaaaaauaguacugaacaaaaugcugccaaauauaaauucaaauaaaugauagaaccauaccuuuaaugcgagucuaaccaauguuagcaagaugucaguucuuccuguguuuauaaaguuaauauacuucaaauacuaugugguuucuuuuaauuauacaaacugacucuacagucgucaauaauagcaacaauaauaauggugauaauaguaauagugcuaaacaagcccaacgaaauuaccagauaauuaaagcaucccauggugccuaaguaauuaaugauuaaauagcuagcaaggugccaguaugugaagggacagaauaugauauccagccguagaugugagaacauguggccguucguuguuuaauaagaugacguuuuauaucauuggagcaaauacgcucuuuacuuaacugauguuggaucauggguccauccuuguuagacucuaagugaauucauaauaaagguguaaacaacaacaaacaaacaaaagaaccagaaauguuguaguagaacacaucagaaaguccuuuuuaugaguauucagagcuccucccagccccccaugcuugaaaaucuaaaauguucagucacagauucugaugacagaucuauaggaaaacagccccacuuggcagagggggcuggaagaugguguguguguguguguguguguguguguguguguguguguguguguguguguguguguaauggaauguaauuugccagcauuucugauguaccagugccugugcccuuugacaugguaauucucccaggaugaucacccacagacacaccagcacaccggugaacugacagguguauuaggccacuuuacaugguguugucugaaaugacaaguucuaucaguagagggauaauaaauagguuuacuguuaucucucaaaccugccuccucauuagaaucaucugggacuuuguuucuacuguuucauuucaaggcucacgugauagccucuaaaccaacuaaauccgcuucuggggaaguaacagugauuuaaacacacaggcaagguuggggaccacucaggguuaucuauagagcagaaugcugucugugaagauaagauggcuguuuucuuguuuuaauacuuucauccauauacaaaaugugcuuugauuaccacccauuaucuucuguuugucccuucuuucccuucuguaucauuuccucccucuguacaaagccucccuuuuauuuucauuaaaaaaaaaaaauacacagaugagauaggcuuuggucuggccagcgucacuucagaugauuguccacuccuuaacuucccgccgauaguuugguuuuauccuugacaucugacacagcugugcgugugcaucacauuuccuucaucuuuuccuggucccauugcuuggcugauguggauaguaacguggaugugucgugugcugacuuagcaucacaucuguacaucccgaagugagguaguagcacauuuuuggccauauaggcuuccauaguaucuaaacuacuucauuuuuauuuccaccaacaauguguacaggcacauuucccccugcauccuugccaguguuuguugaugguugucuuaaugugcuccauugugaauggggugagauuugaaucucggugugguuuacauuugcauuucccugguggcuaaggguguugagcauuucucauguauguauuggucuuuugugcuucuuuugaaaacugcccauuugauuaauuugcccauuuauugguuugauuauuuguucuuuugacauuuaaauuuuguucuuuauauauucaguauauuaaucccuugucagaugaaaagcuaacagauugucucuucacugucuccuuugcuguucagcuuuuuaauuugaaauccuauuuguuaguagagaagacauaccguuuguaaacauagacagaucuagaauacauuaagcaacaaagaaaaaaaaauagcccacuuacugaaagccaauugaguguucuguguuauaguuuuuauauauguaauauaugugugguguuauuauuuaugguguuugauagggucuguaaucaccgaaaagucaagcuucaggcaugccugccaagggccguguuaacuuaaagacgggaagaccaagacuuaggcagcaccagccccuguccugggaaccaguucucucugcuucuugacugaggaugcagugugguaaugagcauccugaagcucaggccaucauguuugccucaccgugaugggcuuugagccagaauacagacucccagcuuuacauugcuuuaguuggcuauuuguucccagcuaauauacuguauauuuuguuaguuuugauuuuaaaccgugcauuugccuguaccagaacaaauucuauucacaaacaaguaucuguaaucuuaaggugaaaucugguaccacucuuuaucuacagguuuacucuuuuccaccauuaaaggcuuagaaagauggaggguugaugacagaugucacaugagggcguaagcagagacugagccccagcuguggaaccccacaauucuuagaacacuggauauggcuguauggcggacagacuaaacugugagcaagucagugacuggucagauagaaaaggagaugacaguucagugucaugguggaaaggaaucggggaugugcagaguugauagcauaagagccaggaggagaucucugauugagauggaggggggaguaagaauccaccucagagacagaggccuucagacagaaagcagggggagaccaucacagccacaaacggagcauggcgcugcuucaccccuacagauggcaauggguugguuaugcagauguacaggugauaccacuucugaaauuuugccucuccgcucuuccuuuaccaacaaaccaugcuaguucuaguuuuguagcuaauucuggccagagaaguaagaacggaaagagaccucucugcucuugguacacaguguaguuggugggagguugugaaagguaugccaagagaggaagugauuuuaggcagaguggaaauuugccaaguagagaaaacagaguuguugacccagcagagaaaacacauuaauugcacguguguaaggaaagauuuucagggguaggcauacucaggaugcuagggaagaauccuagaaauauuuggcaaguuugcagcgggcacuuuaguagaagcccaucuccacugaagacccaaaucugaagauaauaccauuccaggccucaggaaguucagggucuuaacguaggaguggagucuaaauacagcauuaaagcccuaucagagacuuagugcuaagaaaacaaauuucagucuucugcaagaagugggguagcugggccagggagaacgguggagaacaguggccucuccugggcaggcagagguaaagucuagaaagcauaaaaaccaacguugaguaaaaugauguguguggucugggcagggaccugggaacagaacaaaguguccagagggagggugccuacaaugaaaguagcuacugguuuggggucugaugccaggcugcaaggaccaaggaaagccuaaauccauguuuuauacagcaaaggugacuuggggugaacauuuacugggguugcuuguggcaggcuccauaggagauagcagaggugagggacuagaauggcaaaggagaaugccagguggccaguuugcacuguuaucuccuauaaaguacccguuaucgauauaucgugauaccgauauaucuugauugugaaaagugacaacguggucucuguauauucaacaagcauugaaguggagagagccggcuuggcuggccuccugguccccuuuuacauugaggaggcuugcucaggauagcgacuugugagcauguuuaugugcggggugagcagagccccccauccuaagagcagaugguuuccuccgccugggguccuguaaggauggugaagcuggagugagggaaugggagauucaagugagacugccagaaauacuaugggcaaggcaaguuaaccgcuuauuucuuaucaaguggucccaacgccgucauguguuguuucuuuuuguguauguucuccaucccagcugcucccaauaggcucagagcuccuaaaacuugcuaucaaaagauguagcugugugucuggugcaccagcaugccauuaauggcguauuguauagugcaacaauuuuagugugugauuuaaagcaacuuucguaaaagacaauuuuaaauuuuuauucgacggugaggaaggggcuucuggacaaaagcgacuaaaucgguuaucauuccauuggagacuucgucagccauacaagaagugaaaaugauggaaacaaaaccuuugagguucugcacaaaacaaaaaaacgauguguggcuuaaagucagcaguucuggcucgggggggggggggggggggcuccaaacgacgccuccaggugcugacuuuuggggccacccccuuccugcccuccccgcuguggcagccaggauuccuuuugucucgggugcuuccccaccccgcccugccagccagagggagcuggcaccgggcgcccuccccaccgccccuggaccaagguuguuuacuacuuucuacucggaauaacacgccaaucaccagggcccgcccucucucucagccaaucaguuuguugggaaauuccaccuuuccuaagggcccaaccagcgauuggcugcaggacuugucagucaagcuggcaucccgcaaggaugcagcuggaguauuagggacgcgaucaccagagccgaggaggaguaaccuucccauaaacaagauggggggccccccaagaaagcacggauugggguggggagcugaagcucagcccaaccccggggccccaccggagugaagagggccgagcgcagagccggggaaucccucccuccgccucccgcccuugcugcaguuguaaacacgcuucccuccaugucuguuuuucuuucucuaaccguggccauuacaggcugcuguuuacaaaaauccugcagggcagugcuguucucuaggauccuguccuccauucaccuugccucaggaccccuuuucaggcuuuuuuuuuuuuuuuuuuuaauuuucuccccgcugcuaggcacaaacugaaggaagcuauugggucgugcaagcuuguuuuccuuuuauugcagcacgcaaagcaagucacgcuguagcagcagcaccauuucccaggagaacaggcuggcuggccauuaagagcaccgcgcagccuaaacaggcguagcucuagaaggacuggcuggguuuuuguuguuguuauuauuauuacuggucugagucaagcuggaugcuauuuugauucugcauuuucuuccaaaauucgucuugaaaucuauccccacuuacagguuugggauuuacaccaccacccggcgcacgccccuuuucauaaaggcaguauuguguugaacuaaauguuuuucuaccuucucugaucugaaucagguuucccauuucuagcagcacaauguaguuguauucugugugguaggggcguaguggacaugaauuauuugcgacaggguugccuggaagauacggaguggaauuugcguggcacggaacaguucccagugcccaagguuucuguuacucuggcuccaagcaggaagcgcaggcaauauggcaaaacacagcacguggcaucccauucaaaaacgcucuuuucuagaagcugguauugcagaggauauccgaucuugacuaguuucaccaccaccaccaccccuuucacaagcagaaagaaaaacuaauguacggaaauuugguguagauauuuaguaggaagcuuuguuaaguguaaaggcaagguuuggaaguucuggcgagaagcugaaggaccuugugggcacgcuuuacaggauuuaagguuguaggaauuguaacccccacaugggaggccacggaccucugggcuccucuagacuuaacacccugcaaaguuacugagcuacagagcccuggaggaucuuaggguugaugcugagggagaaaggaagguugcugcagguaggaauguggguggcccuagcauguucuggccaggauuggauuuccaggaguagcuucuauggcuaccugugugaguuuguggaagacuccagucuuaaguuaugaaagccugguuaggaucucaguggaugguuggucuuuuuuccuacuuacucauuuguuugaucccaagccccaaaccaccccccccccuuuacacacacaagcagcuuuccccaaaaugaccaaguuaguauguaacacgcuaccguuauauacugagcugucgucaggauuugaguggagguggcugugucgcuuguaguaaggggagguuacgaaggccacagcuggggcagaguucugccucagggcuacaaaguuccuggcaucauuaccccaccuuaugaaguuacaaacugggcaagggguugaaggcagaaagagaccguaaugaagaauguugugaugauguguguaccagcuccugucccuuauuagcugccucauccaggccaaguaaguucaccuccguuagccuccuuguccacugccugaaaggaaagccgugaugucuguguauggcugugagggcucaaugaccuuugucaugcagugggcuugguaccagccugggacuccugacaaaugugucuuaccccuucuuuuuuccgugacccuucccucaaaccucccgcuugcucagggcucaucuuuuccuggugauuuguguuaaccguuccucccuggccaagucagccuguuaauuuuuccaugccaacagcuuccgagugccaggaagucacgucugaauagccaaaguauguuuuccuguaggagagugccagcgugccaaguggcacguccucaguugagcaugcagagcugggggggagggggagggguggugagaccuagcuguacuucccgccaugucuucagauaacuuuuugaaucacgagugaagucuugacuuaauccccuggcuuucauaagcagggcagagcaguggccccggccuggcucucaguucuucuugaccugauuucacccugccaccucugccugugucucccaccacaucaguacacacaugguaugugugcguaccacagugcuaccuggcuccuguggugaggaucugaggucucucuccaguuggggaaauggccuccuugaugccauuugcuagagcacuuccucaagcugaccucuccauauucugucccaguaguaccuuuguucuucucaguccugucucugcuuaagggacaguggcguccucuugugauggauccuucugugauuccugugguugacugacuuuucuucccacagaaaguaguaguuuucucugcacucuaggccagagugaaagcugucugucugucucucuucccucucaguagaauucugaugccuggaauucaggccugacccuucuuucuuaaucuggagcaaacaugguaauaccucuuccuuggggaguugugaggauuaacugugcccggcuucaaguuuauaccugacaggcacccaggaagggggaagaguuaucuuuuuaucauccguagauggaaauguuaguggcuguagaggucugccaaaagaauggcugagaauuauguaaaucagggacuugaucacugcucuuugaccauucccuguaaggaucauacgguuuuuauacuuccuauuugguaacccuuugauaaaucggaaaucagccuuuuguauaauacgcuaagcuaaagagcuaguguuucaucagugauuuuuuuuugaaagcuucuggaaacccuaaccugugggaauuggguccaagagggaaguucaagccaccagagggcagagggaguuuuugucuuuacuucugggguuauugguuugaaguucugacuagugaaugaacgaacgaaugaacgagugguacuugauauacaccuccuggucuucucaagcuggucuuuuugcagacacaggcccgacccugaugaagcuugugaagcugcgggauauggccacagaguggauguaugaugggcaggauccaaugauucugacagccacaguuaggugagcuggguugugcugagcucugcccaguucccucacccuggaaggggucuacuggcuggcagcaagccagcaggacuuaggagccuuacucagcacugacgugugggaugcuuacaaaucaugcccuuccuugaaagagauccauucagcuguccuacagccagcuaauagaaucagcauagucuguaaucuuuaccagagcuuuuccauuuauauaccuauaacucuaugugaucuggcaagucaguuucgcccaagccuugguuuccuccucuuuauuguauagacaauauccaggugaaggguaggugaaauaguauauggaaagugaaaagcucugggccauuuaaagacgaacagauagacauuagcucugacuguacagauauguagacaacgcuaaugccauuuggaaggagccauuguugagcauggaagagacugagcugugguauacuaccugaaucagucuucuggguugcucugagauugcauuugaaaguaaagagguugcuauccaauauaaagacuuguauccaggcucuauaaagacguguguccaggcucuagagggauguuggcuguuguuuaacagaauaccauucuucuuuuguuucauucagucauuucccaaacauccaaccaucuguuugguuacaagcauugugcuuauaauaggggggugcagcaucaaagaggggccuuacucucugcucacacagggcugaguguuggaaaggaaauagagaggcacggggauggagacaccugcccucucuacaaucugguacguguguugaccugggaugcucuuucccuguaaaagcagucauuugcccuuucuucuguaaauaucuccuuucucuguacguagggaccccacucaagucggguuguuagggaagaagcauuuuacgguagagaguaaggggccaggccuggggagagaaugcauacccaacuuagcuuuguacaugaaguugcuuagggaaaugcacacaaacacaaaggccugacaauuacguaaccuguguagaguaacacacaccuggcagucccaaagggagccggaagaucaguucaaggccaucuucagagacauggcgaaauugaggccagcaugagcuaugugagagcuggacugagaccacaccccugcucuucugucugaccugcacuguuacucuguagucuugugccucgacagauccccugugucugcccugcgugugguagccgggaguugaguaguugagaaacauuuaggauguggugagcucucuucguugcacuuuuuacuuaaucuuaacuguuucaaguuucagaggccuccuguggccuccuguggccccugagcagcacagaucaagaugcagauuaacaaaauaaucucuaaaggauguggauugggguuuuuuuguuuuguuuuuuagugguuuuuuugguuuggguuuggggaggggguuguuuuuguuuuuuguuuucuguuuguucuuugucuaaaguaauuaguaguuaaagucuguauauaucauuuucccuauccuauuuaagacuaauaaaaaaaaauacauacacuuaaaaauguguauuuuaaaaaugugccguccagccuagagccucugccugcucauacacacuaaggcuguagagugccccuaagaacuggguacugagagugaccugcugugcgugacugacuaacaagggguuaacaggcccagggaagaguuugagagaaagcaacuaggacaagcuccaugguucugccaaauggcuuuugauucauagguauucaaaagcuuuuguggcuaugaaaauaaacuagauuuuaaaacauuuugaaauaaaauugaaacucauuugagcugaaagcguugaguugcuucuuguuuuuuuuuuuuuuuguuuguuugguuuuuuuuuucuuuugguuuauuuguggcucugucccccucagcuuugcuauuucaugagauuuggagaauaaagccuagccggucaguuucaauuuuauuuaaauucauuuugccuucauucucccucauccagcucaguccugugauauauugggaucagagugcucgcaggaaacguugagauauaaaaacauuuucaugaaaacguuuccacuuacacuuaauuuuuucucaauagaaaaaaaacuauuuccagcuuaauccugccucuccccucuugaaaugaauugugugcuuuagaaauaacaucaauccacacaaggacagacucaaccauuuaauggaagguagaaaggcuggagaacacugccuucagaagcacacacucugccuuucuggauggucaacgcgagcgcguuucucaucugggccccgguuuguuccugaacaagacggcaagcgggcauagcacuaagcugaggcccgccacggggaaagccucuugcuccaucuuaagccgucaucccaucuuuaccgucaucgcccgaguuuuauuuuugaacgacuugggagcaucugccaaggcuagcugauguugaaacuuccuuucugcaaguccccuaugacaucuggguccagcuaugugggaagguguuggaacacgccguggauggagccuugcucacucuuuucuugagggaggaaagcaagccaucuccucucagugguggcauuccuccuucccuugacucuuggaagacacuguuuccuacagcaguguucugcucuugagaaguccagucccugagggacagaagccugucuucuaaauaagcuaggggaagccauaaagaaaauaaagaguccuagcaggaauauuggcagucccagcuuuacuguguucucauuccaaguauaaaacccacugacaccagggucccuggaaaaguugacccugaucaccugugggauauugagcccuguuuugagaguacauuuaucauuuaguuuuugcugcagauuuugguaaagucuaccaauguuauuuuccuggugagcaaauagaagucuagaacuaaaacuaaacucugucugucuuucuugugcacagacaccccugccccugguaaaacaggguuuaaacuaagccucaguuuuaaaugugugcacuagaaaaggauauuaguuccccuguaggucuucuccugaagaagaugcuucuaagccuccaugugugauaggaauugagccuggguccucuggaagagcagccagugcucuucacuaucaaaccaucccuccauucccaacuuaaaugugagcuuaaauauugaaaccuuuuuaauuacuuaguccaguuucaguuacagccaaaaauuuagugaagacuguuucagacucaagcuccugacacuauaggagacagguuagugguaagucagucuugagaaagucacuagguagcaggaaccucuccucucaugcccggggaccaauaucccucagugagaaagcgugaccaggugauacacagaccgagggcugagacuucugcucccguuuuccugcacugucccuugcuggagaucuuuccagcaugcauucagaaccgcugcacuuuuuacucuagugaacacugguuauuucuuacccgcucaggaacaucagcgagcauacauaacuuguauuaugcuuaauccagcagugcccuccggcgugagaaggaagcaguucgcucucugcugacaguuucuugcacucacuguguucugacggucuggguuuaucauuuuuaugccuccuuuucuguuuaauagacucaccccaguaagagaagucugucuccaucagcuccucugcagguguuuauuugcuuggagugcuuugaaaagagaugagcauugcuuguuaccacugugugagagagcaagcaagcagcagcucagagcuggcugcuuccugguucccagcuacacccuagaaguauguucuuuugaggguuggguucuggaaagugaacgacaagucugugaguuacccuucacgugagguugguuugcucuccugaccucccucuaccuaccugcuucuuucacagcauggcguuucuggagucauuaagauaaagacacauuuagcugcauuguagccuccagcagaggucaaacccaucuucacaaggaugcaguucucacuacugcgccuauccuggacaaguccucagguccuaauuucaugacuuccugugccuucucucagauaaccaccugaaaaggcuucucccaagcagcucgccguaagcgcuccuaguccuuaccaccagccaccgucaagagcccucuugguccgucucuguccucagauguucccugugaagaacacagccuguuacccucugggcuaccagacaccaugagucuaguguuggacucucugcaaaugaagugcauuauaauuuaggaggcaaccuugcauaauauacuagagucuggcuccuggccugggccaaccugaguaccuguucccuucagccauacccaggcuaucuaauccuacacauguugggcaggccuuugugucucugcugccugucucuaaagggggcucaagccugaaaccccagcuauucagaaggcugugcagaaggguuucuuuuuuuuuaauuuauuuauuucuauauaaguacacuauagcuaucuucagacacuuuuucgucucucuccccagccccguucgcuccaacccaaagauguauuuauuuauuauauguaaguacauguagcugucuucagacaccccagaagagggcaucggaucucauuagggaugguuugugagccauuucaacucaggaccugugggagagcagucagugcucuuauccgcugagccaucucuccaauccugcagaaggauuucuugagcucgggaguuagagaugagcacuggugaugaaguaagacaccagcucaacagagaacaaacuugugucauaccauugauucagaggacuuagcauagcucucggagccagccaagaaccuggaccagcuguauccacuccuuucugucucauuaccuggagggggcaccucgacuccaaagagacagugcaucccuuugcgguggaguacuccucuguugugcuauacacgccuuaacacucagcaucaccgaaguaaaaaugguagccuucuuacauucaccuggggccuuaguuuguucuucuuugccagugaauauaguuacauuuaaggcuacucccagaaugaagaaucucagguuguucuagucaaagcuugacaaggucuuuuuacugcccucacuaccaccacauagugauagaugaggaaacuaaggcuugugauacugggagcugucugcuuacacauuagucucccucucccccuuggaaagagugggaucaaucucauguuaaacuuuccaagcucagaggaugcuaucugugacagaagacagaacaaugucugcucccauaaacaaggacuccaaaggacccaaaaaggguguguguguguguguuuaguuuguauggauguuuugccuggguguguaucuguguaccacuugcgugcuugcagccuaggaaaagggcaugggacaugcgggacaagugcgacagaugguuauauucucguugagcaucucguuaacggcuuucucuucaugaacacucaguguacccuccacuuccguugcacuggaggguaacaugagauagauggggaauugugagaacguaaacgcccccacaccauccccauuggugaccagcucugccagccugaagaccuuccaaagaagcauauccuugaugugucccuacgcaaaguagagauuucucuccucccgaaggaagaguguugccuuauugucaaacugucggggacauuguguuccauaugucacuaaguugcuuuuauuuaccuuaggaacuuaaaaaaaaaacacuuuguuuuauaugaaauauuucugcuucaguuuugcacacgugggggugggaggugucugacaucuucuaauuagcaucuuacaaaaccccgaugaagcuguccgaaccaugaagguagcaccugcacuguacugccaccaucugccccuucuucccagugcccuuugaccucucuugugccauuugugguuccugauccaggagcggugcccacccagcucugauuccuguccuccuugauuucuccgauuccgggacacuuuucccacacuucaguagcucgauccagguacuucaugggaggucauuccuugcagccccacacacagccuccugugcucuuuccugcugugaagagucaguacgucagccugccagggcaccugaugccccaugcuuagguaauugugacacuugguuaaugcugucucugcaagguccucucgucacuuaacaucuuuauuuuuaucucuaauuaagaaguacuuugagacagaucucgggacucucuaaacacacuguucauuauuucuuccccuccucauucaacacccauugcuguggcauuggccaaauggugauuuccuauuuuuguuuuguuuuguuuuuguacuugguaauugacguucuccugcuaggacuuuguguauccuuuuaaaguguagaacacaaaacuuuuaaaauagcagugcuagguccacuuuuaucagggaggacaauuacacgugcuaugaaguagaaaaauacgcagagccagaaaauaucucaaauaugaauguuauuugaaauguuccuacuguuuuucccugcagaggaggcagagggcucagcugccaaaauagccccaguaguuuuggucccagacacagaagucuuacuuccaaggucucagagacaggaugcucagagagaggggcugacaucagagaauauucauuguggguugauugggagggaggacuuaccucaacacaaggcaucugauggaaccuuacuucuucucuccaugcucuucaagcuuuggugaagacuuccugaggcacggcuuccuuuuuguagauacuuuugcuguagaaaacagggugaguggaggaggggcacuaaaggucagcgucaccagauguauugguuuguuccaaaggaaacauucugaaggggaaggauugaaaccaggggauuucacaugccaagcacacacucugucacagugcuacacacacacacacacacacacauauaaaccauaccacauacacacacucacacacacauaaaucacaucacauacacacauaaacuauaccacauacuuucucucucuagcucgcucucucucucucugccuauuuugaaaacauuaaacaacucuccuuaucuuaaagaguuauuaaaaagcgggagcgaauuuuacucuaugcuuuuucuuuaguccuucuuacccagacuucaucugccccuuagaagacugagaauauuuauguucuuccucuguguuuaaucagguuuuaugcauguguuugguagagcuaugaaggcuuacacacuuacuuacucuugagcucccucccagaaaucuguaaggacggugagcuuccugcagcccccguguucccucacugauagugugcuaaccagucacaaaugaaauucuagggaguaugaaauggagcuguuauauuuggauggggggagaaaaaggaauccuaggcauuucagacaucaagcauucagugacaucagcugucagucacacauaccgacuagacgaggaggaaguuugacagugggacucaggauucugauuccauuuaauacacugaguauaacaucgagguauuggcagugagauugugcagaauuugugugucacauccuccguguucuguuguguuugcguuucuuggagaguauuugaaauuuggcagcaaaacagcagagauagguaaaauuucugaguguuauuucuacacccuaaguggaaaucaaugccauuguaugcuuaagaugauugcaggugccaaccugggcuuagagaaugcugugccgcuccugauugggugccagcugggcgguacuagaagugguauguuagguuccaggcauacccacuaccaccucacguggucuccagcaggccugggcucguugcagaggguggcuggauuucuagguuggaaggcaccuuccuugccuugguuggcuuuuaauucuacaguacauugagaaggcuuccaaaguuuguuguuccucucccaccaugcccucuuaauccuaaauuuuuggaagacccucuuuuugcauggccacagcacccaauaggacagggguuccacgccccagucagcaguauuuuauauagaaaaagauccuuccaaccugucucgcuacacauuagcaugucuuaaugaugaucugagguuuggguaggagaccaguaauucuggaacuauaggaaaaguguucccaacugccgugacccugcaacaguauugcccccuuucucuguugcuggaggcagcucauggaagaaagaacuugccuaggucacucagagagcugcugacucucguuagcacaccacacaguuuaaaaugaaaaguugcagagugugcuugcaaaagaggcagacuaacguggaguaaagaauaggcucacauggaauugaggcucaugggugagugcuguacucugguacucgcugugacagggguccaggcuucacaaaagagggggaguggucaagucuuccgaggaagcuuccucuauccccauccccaccucucacacuggacacaagcacccuccuuaacuuaacccugaagccuggggugugcccgauccuaauguuaagucuccagcacacuugaaucuucccagccgcucuguuuucuuuuuuuuuuuuuuuucuuccuucacuaaaacucaauacaaacaguuccguaauggagaucucagacgauagaagcaauuuguugaaaaugaaaaaagaaaagggaaaaaaaaaaagcccugaaagacuaagcuucuuuuuaaaagagccaaacacucuuguuaauacuuugggaaacagaaauguaacuuuggguaaauuaucucagagucauggcgguucggacuuagguggggaagucaucuuuuaggggucuccuugcaugagcaccacauaaucagcauauucauguguacccuggucuagcucagaccuucaggagcugugaagccuuccuguuggggugcucagaagcauaggagugaaaccagaaauugcuaagcaugagaggaagagggucgccauccacucuuggcucccuucuucuggcucuccaccuuguaggcguuaauguuuaaaaaacauucucaucaagcaugguccuuuuuagaauucacaggaucuauggggucagggaguaugagugaaugugaaaaugcucguuuguuuuaacaaacgacagagguuuggggguuuuuucccuccacugccugugcagccuuccacacuguuaggcagucaggaagcccagcccagcaaggccauuaagccauccuuccuuguaauaggaggagcaggaggcagguaccaguggcauggcaccucucacaauggagguugguugguugguugguugguugguuuuuaaauuuaaaugagggauuguagauaguuugaaaucuucuuguaccaggagaaacagaaugaaaaacuagcaucuucuagucaacucaggaaacuguguuguuuuaaacagauuggcuguguuuaguuauauaccuuuuaaacagaguauuacuaaguuaaacuuuuaaggcauuuuaguuaucaguaaagaugauaauuaggcuggagagauggcucagugguuaaaagcacugacugcucuuccagagguccugaguucaauucccagcaaccacaugguggcucacagccauuuguagugggaaucugaugcccccuucuagugugucugaagagugacaguguacucacaugcauaaaauaaauaaauaaagaugauaauugauaguuuucccuugaaaugcauggaucuaaggggcccacccccaccaucacuccagcagauucucaugcauacauggacccugccgggagcaccugcuuuacacaugccuuuccacgccauggucuuggcuggcagugcucuuggcuuccugauacgcaucuuuaugacauaagucugugccuuacucauuaucuaugugcacaucuccuuuccuggucuuuguguggaaggccuugugcacuucugugcucucccuuggcgccuggcaugccuugcaagugaacucgaguaguuaaugaacaaauauuuaauucauagaaacuuucagacgacaagcucuucaacaguguauaugugugugcacauauccauuauuaaauccuguguuuaauguucuucugcuucugugcucuaccaguuuguacgaauuacacuguuugaaguagaaauaauugaguauuuagauguccuaagcgucgccgccagguuugccaccaccuucugguuugcuuacguuguggaucugaaacaaggucuugauguguuuuccccugccagccuuugaacuccucuucccaaguccuccucuuccucagccaucuuaaguucugagacuacagaagagugcuacugugcccagcuuccauuuuuuuuuuaaaggcaaauuguuguccucuuuaucaucgggauggcucagaauaauccuuugcauuuuucaaccauggaaaugggcuucuuguaaugcuuacuggaaaaggcacaucagcugugccuucuagcaagacaugcccauuuagaacuacgucugcugucccugagaucuuccugcuugcuaugagaauauuuccagugacucuggaaccggggcagguccaccacaguguauuggucacaaacuuugagaccucaaggcucagccacuuagaauuccagcuuugccuccugcaggcugugugacucugaccauucaugacauuugcucuguguucuuggcucugguucugaaggugagaaggcugcaggucuuccugccauccuggggucccuguggaaaugaacacaggcagcacaggguaaacuaccaugaagccgcacacagcccaaauggaagaagguaccuuguuacuaauagcaauaggcacacauuguuucuguggccaugccuuugguuuuggcuuuuuuuuuuuuuuggaagauggauggauggauggauggauggauggauggauggauggauggauggauggauggauuuacugaugguugugaaccuucaugugguuguugggaauugaauuuuaggaacucugcuugcucuggcccagagacuuauuuauuauuauacugaguacacuguagcugacuucagaagcaccagaagagggcaucggaucucauuaugggugguuguaagccaccaugugguugcugggauuugaacuuggggcuuucagaaaagcagucagugcucuuacccgcugagccagaccagguuugagggugguuguuguuguuguuguuguuguuuuguuuuucuguuuguucguuauacccugcugccucccugccccacuuccuuccuggaaucuggcuccucugggauuccaagcaaaggcagaaaaaaggcagugcacucugcauccacucucucaggaccucccuggaccagugcauaaaauucaagggcucugauucuggccaguuccugugaguaguucauuaacaccgauccaagucucccuaaaagggaaacgaugacugaccuauccccagaacacuccacccuguacccgugaaacacuagcucuucuuucuugguugcucgguagaccuugaacaaaauaaagcuuucaagucagcugaagaggaagcugugacauaaaauguugggguggcaggaguugucaccaccucaaagacagggaaggcaggcggcaggcaggucacugggacaucugcaggaugucuguggagaacagaaagcggcauaugcugaaugagcagcaggucccaagguccugagucaggacuacacauguacagaaguaggguauauauguguguguuuauguguguuuguguaugcaugaguguguguacaugcauguguguguauaugugagcacguguguguuuguguuuaugugugugaguguguaugugugugugugagccuuugugcauguuuguguuuaugugugugugcgugucuauguauguguuccguuugugugugugcauauguguguguguguauuugccccuucccaugccuaccuccauguagccacacauuaucuguuggcaugccacagcccuuccauaaccuaaauagcaacucacaauuguauaccugcaacuacaggagauucuggcagucuuuguugacaggaugggugaauccaucuuccucgaucugggcuaugagaggggaagugagagaagcugagcaggcugucugugcauuccuggaauacugcccugacugugucgugcagcaagcauaaaaggcuaucucuggccacuggcuauagaugaccuuuuccugugacugaagaucagugaguccuagauaguagugguacaaauggaaggagaacuggauguucuagugaccagccaacaagcuggauacccuccccaucuugaugaucaggaguguguggacaguaccugugcuucuuaagccugcacuugcuccaucuaguccagcccauggauccuggaagaaaugccuuggaccuagaaaacgaauagcaaaugcuuucucagucucccaccaagccuccaacuugugggggccuccagcugcacaugcagcagggaacuaguugcagaaucauuucuaaucucccagguuagcauugucuguuucuuuugaguauuugggguacucaacccaguuuuggguguuaccauuauacaguucucuaacuaccucugucugaaucccguaauuaauauuaaggggcccugcuuccucacuugguuugguugugaguaaugauucaucaccacacaggaaagagcuucuguaucuaugcuaacaccagcguuuauaauguaagcugaagcaaaguugaguaaaguuauguauuggaaggauucuuccucccuuuuuaaaacagagucucauguagcccagucuagucugccuugcauucuucacuauauagccaggaguaacuuugaacuuggagucccccugccacuaucuccagggacugggauuagaggccucuauuaccaugccccauuuaaacggugcugggaauugaacccaggacuucucggauagagauaagcacuacacuaacugagccacagucccagucucucuuuguguuucaaaacagauuuuucgaaacacagaagucuccuuccuugucuuggaauagcuugcuaccuggcagacauguuauuuacguguuuucucuguuuuagcguuccuggggguuggaaccagggcugcaagcaugcuaggcaagcacacugccccugagcuacagcuccuguaccugaugaaguguuaauccccacaugaccucaguggucagccugugucucuguacauuccuagaacugcacaaaaccaaaccaccaucaccauugaaccuucagggaguucugggugagcccaggucuauuguggaucacacagagguuacucuaggacagaagggucugagaagaguacugaaauuaagaaaacggucuuuuaaaguuuauaaaaguuuuauuugaucagaagugagguuuaaguacuucagauuccugcccuuacgggccaguaagaggcuuagcagguaaaggcuagagaaagugacucccacacuuacccucugccuuucacugguauaccauggccugugcacacacacacacacacacacacacacauacucucacacacaccucugcccuucauguguacaccuuggccugugcacacaugcauacacacacacacacacacacgcacacacacacaauuucacauaauuuuuaaaauugaaaacauucuuuaguucucuuuuucuuucuuauucaucuaaccauccuuccaugaaaccagaucugcagcucuucagcacaugaagggaacuaacuagaagcucuucgucacguuccuuuuccaagcgugccguggcggaagguccuaggagccuccucaucucuucuauaccugugcaccaguuaguugcacuguuacauaguuggcaaagccaaggugagaauccaguccagagacuuacguggagacagcagcugauauugacagagcacugccgaugugcaggagacacuugcugucgcugugugccuugcugcguguguucaugggcuaacagugcgggguggugucugucaucugccuccgguggaacucugaggaggcagagucccuuugacuuacagcagcugacagggcuggacugugaacuucucccaagcccguguucuucuguaaccagacagcugcucgguaauauguuucuaacacagagcaugaaccucacucuccccgaaaccaauuuugaaaacuguaggcagagaagacagacagacagacauuccuugggccuuuucaaauguggccacagcggcaugcagaugggccucgucuguucuuaaguuguugcuuuaacugcugccaccauggcuuccgggcugguagguuuugguuuuuuguuuuguuuuguuuuuuaaugauauuuggcaugauuaaugugcagaggaaugcuaccccgugccauugugucccucuucccagaagaugagccuagccauucagggcccaccucagggaauguggauccacagaaugaagcaaucccauucaaagcaaaugaccauguuaccgggcuggcagauuguuuuuguuauugaauaaccugaaacacaucaacagguuccaauuaaauucuuucuguuucuaauuucacugaugauccucucaaauaauauuagugaguuaagggccaacuuaaaacuuaauguuuuauaaauugauuugagcuuuuuuuuuuuuuucaaaaacuguguauauguauaugugggugcgcuugcugccuauguguguaguauauggggugugcuugcugccuguguguguaguauauggggugcgcuugcugccuguguguguaguauauggggugcacuugcugccuauguguguaguauauggggugcgcuuucugccuguauguguaguauauggggugcacuuucugccuguguguguaguauauggggugcacuugcugccugugugugcaugugcacaggugaaggccacaguugacggugggugucgaccaucauccucuagccaucuccaccuugauuaucacuauuaucuuuacuacaacaucucccugaacccagagguugcuauuucaacgagggcgucuagccagggagaucccaggguccuguugccaaguccugugcuuuauuuggcugcuaggaaaccaaacgcaggcccuauguuuguggaacaccaggcacuuuaccuacugagccaucuccccagcccaggaugguguucuugguaccuauccuuguccaaggggaagcaccuauaggacucacaucaaugaaacacaauucauggacucucuuucucgauuaccuaagggauagacugauuuacaggugguuucuucagaaaucccaagcaucuuccaguggggcagaagauaugcaaccaguguacuuccgugcuccccuccacgugggccuugagacuugaacgugagacagaacuagaaaaauaccugaucaagaugauauuuucuuagcauguggcuaacuuaacauaaaauguuuaugcgucguugucucuggcaugggacuuucuguguaggugguggcagaguuccuguggguuucacaaacacuagagccaggagaguugcgauauguacccuccguggccacagcaacaggaaggaguuuccuaacccacaguguagguggaagguggaaguaucagagaggauguuuuuuucccacccccaaacuguuugaaguucccaaguguuccagugggacugcaugagagcggugcucuuaggaguucugaacgcugggcuuuggaggccaugaucucgugccgagaugugcucuggucggaauugcugccuacaauacccuguggguaaaacggauauuucgagcaugacugagcuuauuaagagcccuacagggcuuccucugcugggguuuagaaauuucaaaggguuggggaguggguggagggcaggauuacggacacgcaguguggagagggcaggaggacggaaguaucaggcuugggaugugucauuugugcuguugaauggcaccaggccagcgugccagugugggcugagaaugucaauuuaggaagauacagugcaggagaaaguucaggugcugccaaugcggauagacgggcaccaaggaaaccguaauuaggggacacucauccagccgaucuugcuuguuuacaaggugagagacgagugcaguuagagaaugcacguaguaaaacguuucaggguuggaaauuagaggugcuuaaauugauuucaaaauccccaguauuucuuuaaggaaggugugcgguucguguguucaaagggcuugugauuucaaagaugaagaaaagcugcuuuucuggugucccaaucccuguguucacuccuuggaagcuugaacaagcuccccccaaccccccuccagugagugagcgagcacuacaaccuuccucgcuuagauugcuugaacuucacuuucuccaucugccaagugaagauguccguccucuggguucauaguuccugaguugccuuugcuccagaauccaguagcucuuggggaguuuucucuugcaaaggugcucgcucccaggccccauggagaagcagaacagaggaaugcagcccagacuugugguggccauuccuccucucuccugcguuccuaggccgugggagagaggcccccgugggagaguggagaccaccaaaagccuuccccuuuucacaaagcauugcauaacagaaguugcaugucuggcucccauuacagggaguugagcacagcuucugccuuuaccugggucacugucauugccugcaaaguauguucuguuuguuccauccucuuaacccuuuuucacuucaacgcucgcucugucucuaaaucgggacaaagcacaccuugacauacgcugcagacuaggauacaggcuccacggcuucugcacccugaccucccugccuccuccugcuggaugaggaaacucuggggucugaagaaaggcagcagcuccuuugacaugaaugucaaggaaguugcuacagugcuuauugcccccaccuccaccucacccccgaguggaagagaugacucuggcuuuuucagacccucgcuuucagacugaguccagaauuuggaaaaccuggggauacuuucuuagaagaggaagacucugauaguuugggaguucgcagcauuuaaggcuucucugcuuaaaaguugauuuggaggaauggagagaugguucugcaagugugagaagcugaguucagauccccggcauccguguaaaaacuaaguggccuuaggaaacagaaaaggccugcugguuaccagcuuggccagucaguaagcuccugcuucagugagagccccugcuucacaagaccaggcagagagcaauaguggaaagcauacugcauugcccuuuugucuuccacgugcacuacaugugcacacacacaccugcacauuuaaguugauuuggaaaauaugguccuguaucuuaggcaucgcuguauaggcaccagucccuuuguguagcaacuaaacuucgcguguccuugacauugccaaacuucuguggggucacaggucccguuguaggaggcggagugcaguuuggcccuuucccauuucugaaugcuuccauuuuuauaccacggauaaagugauucuugaacaccauuccaaguuccagacucaucuaugcuuuacgggcuggcacugucugcuuacugggguucagguuuauagagauaguuaaucuaccuguuaauuccuucagcuuccaaugaaaauucccgugaaccguagaaaaccagccuagaggguauuccagaacaugucuggaggugaugaagggagaccugggcuaaagguucaaacgggaaggaagcagaaagcuaccuguaucucccucccucuguaugaccuucccugcucccagccccguggggucaggugacaucacaggacuaugcaggugcccuguacacagugucugaaaggauacccuggguucacccucgucuucagagguccaggaugcuucucauugcuucagucucuuacauccaagggugauaauggauaggucugagcaaucaaggaacacuugaugauuuggacagcaccuuagaguaaaccagauuaucugagaucaggagauaauaguucaaagaccaaauaaaaauuuacagacauacaguuccuaauuaauuggaaaaaacagaaggggccucucucuguuggcaucuucauccgaacuguucagucagcuggcgugcguucuacccacugugccuaggauggcucccagucuggacccaauuuuguaguuguuguuguggugguuuugauuuugguuuuauuuuuguguuuguuuauuuuucucuauguaccucuguccuggaacuugaucuguagacuaggcuggccucaagcucacauagauccaccugccucugccucccaagugcugcaauuguaggugcaugccaccgcugcccaccuaagugcucaacuauuaaucguuuuaaaaaaugguuuuaaaaaagagcguggcaucucgaacuuugaaugccuucagugaacuuuuuaacggugggcaguaccauuuuuaaaaacaaaacgaaaaaaccugguugaaacugagaagugaucauuuccagaauacucggauuccuauuggcacuauggggcaucaacacuugcgaugcguuuuagccaaguugguaccuuuuuccacccccucugcucacaaaauucaagcaaaguacaaugaaagccaacagaagucugugugugcgcacaugcacacucagaaaaagagagagauucuagaaaugguaucucaacaguugcauggucucuuuucuagguacuuuuuaacagugagauaggcugauuaugaauauuccauguauuuaugcuagugauaguauuuuucaggauguacaauuaucagggacaaugcuuuucuacccuccuagauaauuuaaaggucuagcugagcuuuuuuuuuuuuuuuaaugauugcuacuugguaaguaaaaguauguaguaggaugguccugggaauaccuaagucauguuuccagccaaguuacaggagcagagcagcaggaugaaggaaguggugagcagagaggcaggggccucagaggagcaggcugaaggucacuugaccagcuguugauauccgugcuguguuuagaaagugcgugcuucuucaagaacugcgacugauuuaaacgcagcugugcauccuggagguucagucacaucagugauccuguucaggucggggcuauaaugaugucacaguccuccuaguuccuguaaacuucacugugugcauacagugacugaguugccuuagacauguuucucagggauguuuuuagugguaauuuauuucauacauggacauaagagauggcuguaaugaaguuuaagauucuagaaaggaaugaaucuggagacauuaagaggugauauaaacuggaaaagaaaaggcuaugcaguaaaaauaaaccaccuucauaauuagucacaggauugaggugugaggugccuguuaccccuucugaucuuucccaaaaaggaagcguggacuguggacugccuuuuccuccuuuucauggggaguuccuccucuuggagcagcaugaagcgagacaacuacagucaccagagcauuguuuuagagaagauuccaggaguugguuuugauuuuuuucuuccaaacuaugacuaggcagccuuagagcagcuguucuuacaguugaugggagcagcugugaauaggggauucguguccauguacauguagccauccgaauuccauggguagucuaugugcgcguguaucuuucacauuuauuacucucuccaugaaccgucuugcuuuucguaacagaacuuaauccuaggccucaugugcucugcucugaguacuaguugucccaugggugacucuggucagucauuucaguuaucuucacauaaacauuuguguauggagagaggcuuaugcaugaccuguuaaagccuugcacccuuuggugacacaauuccacuaaaaucaaguggaagaggugacaugagcgggcacacagauuuaaggcacugaccugggaauguguguauugaugaauucacaccaucagaacagaucucucagccaucaccaggugugcgauugucccaaaacaggcucaaacacccguuuagagaggugcagucuagccggguggaggugguauaaacacucgguaggcagagaggcaaauggaucucugugaauuugaggcuagccuggucuacagaggaagucccaggacagccaggguuuacaaagcaacucugucuuuaaaauaaauaaauaaaauaaagcaaacaaacaaaaccaacagcaaaagaucugccugagcaaugaugggugcuugagaccuccccucugagccuggccuucacuuggucauugcaaccccucaccccgucucccacugauuugccccuauggaacacaggccugccuuguuaggaaguaaguagcauuucagagcccacacggcuucacauaacucugcguacaguaccagagaauggaaauagggcuggacgcacgcacaagcagagaaguuauaaauagagacuacucucucaauuccgcuucaguuagucauggagcgaccgugugaguuucauaaacuuauaaggaauauacaaacaguuccagauuuaaaauaacuuagaguaauuuuuaagugugugaaggguauuuuuuuuccccauccuguccauuugagcaucugugacaggcagucacaagugaucuuuaugugcucaagccugcugagaacggcugcaggggagucggcccucugcagggacuucuugcuucuuuuccuuuuuucagaacucuugaggacaaagugugugacuuuugugagacagagauucuccauccuugaagcagccaugaagcugcccuccccugcugaccaugccccaucagcuugagggcccugucuguccugacccccaugccagcucucuuuguuuguuuucuccccuguguuaaaaucugccugcaguuuuucaaauuuguauguggguuuuaaaauagguugaaaaucgcguuuucgacuauuuaaaaguacacgggaauuaagacagucugugagaacaauauagugcugguaaaaggacucuaagguugagcugcacccuucgucaccaucuuuuccauugacucucuccugcccuuccuuuucucucuccccaucuuagcagagcuucaguguugcagcuucagccauccauuugucaggcauuucuacagagcucaagcucaugugugugcacuugguuuuccauaaguggcacagguagcuugcugagcagaggggagacacaguccacacuguaggugacaauuccucuacagauuaugcccacugugacagcccugucuaucaaagaauggcccaaguuaguggauagaguuagccaaaaauacagagucugggaugcaaacagacccuucucagcaccuugccuggaccucagcauccaccauccuuugacauccuuaccccuuccgaguuugucaguguuucuagcauuucuacucccaauaccuacgauguuaucacuccacauuaauagaaaggcucgcuuucccacagugagaaucaguacagcccaaagccagaaggacuaguagacaccaugccaagggugaauauugaaagcauuguuuuaaauggaagacaguggcuacaggagaacacccuuuguuugauuccacuaaguaaaaugcuccuggcaggcgauucaguggagaaguggagacgaguaagauuagucauuccccagagcugggggaagcuuugcuauguaugggcuuuuugcuuugggaugaugaaaauauucuaacgucgauuguggcaguauuugcacaacucuacgaagacacugaaaaccaccagacuuucugcuuuuuuaaguguguguguguguguguguguguguguguuuguaaagcugauauuacaaaaugugcaggaagaagaaaggaaacucuuagcccaccgugggcagagcccucucuguucugccggccuuugucauuuauugaaauuuccugcucucccucuuugggucagcugcaccucgguccucacucuuuccacgcagcuuucuaguuauaauguugcuauuuauaacuucccuccgcaggcuucuuuguuaccccuuuugcaguguuuguuuuccuguuuucucaguacucugcccagcacugcuugguucccgaggccucagugaucccacaggcauugucaguaggcgauuguuucuuuugcucauuaaugaaauguucccagaugcuucagcagcugaacucuguggcuuaccuucuguccuggacugugcgaugcuacucgguuauuuucuccgagccuucaaacugugcucucccaaaaggaggacgcacugaacuguuccccaacuuagaaacauuauugggggaggagacuccuaccuacaccacagcauguauguggcagucagaaaacacuugguaggaauugauucugucccuccuccaugugacuuccagggugaggggggugggggucgaacaggccaucagaaggauagcuguuuuaucuacccacugagccaucucaacuggcccugacucagauuuucuuccacgacaaaguuuccaucuuacagaacuguauggcuugcuaaagagaaugccucugugcuguuagaguggguuuacaagcuugggaaggagcagcucuugagugaggcaugaguugugaccuagcaagguuccuggaaggaugcuaugaucaccucucagaguauugucucagggcauuugaaaaccuaagcaugcuuacugcauucagucgacuuauuugguccgagcugacucugaggagccuguagucuuuugggucuuguuggucugguuggucugaugucacagucauuuccuaucagguaagccauguugacugugcaucuuucagaagagaagcuucucuguuagugugcaacuuugcaguggcucuuagagauaccaacaagauccagccuggcggccaggcagggugguccacaucuuuaaucauaacacucugaaaauggaggcagguggaucccuaaguucaaggccagccuggucuguggaucgaguuccaaaacaaccaaggcuauacagagaaacccugucucaugaaaaaaaaaaaaaaucuagucuuuuaaauuuguggcagaaaaauguccaugagacuuccauuggcuacaacucaauagaggacacugaguugauacauauuauuucucuaguaucacuuguaugcacgaggcggggcucuucgguguguauguuacuuuguuuuguccucuagauuuagggauauaccucaagagaguagaaaaggguaguagggcuuuugguuuauuucuuccuuaugguugcaugcuuaaaaagaaaacuagcaugcaagcaacuccccugcagcaugccuuucagacagcagagaggcucagaagccguccacaccacgaugggaagauguguggagaggcugcugucaucuguuggggacucugagugugacacccaacaacggcacagcagccugauccucuugcaugaguucuuuaaucucuccgaugucuccaguuuguccaucucuaagugaaggaugccuacccuuugugauuaucaggaggauuaaauaaugcauauaaguaacacaccuaaagugucaucaggcauaugggaaauaacacugaaaguuaacuccguauuaauaagcagccuuguauuuugccuuugugguauaaauuggauuuauauaagagagacucagacagcuauuguggaaaggcugaccugggagaucucagugauuagaggcucagaaugagccugcagagugugggcauguccuuacuuuugagaucugagucugagcaaguuacccuagccguggcagaccacaucuuucagucucagcauauuccacacugauucaaaugauccugugcuguuagaauaggguugcaagcaugugggagagagcagccuugccccgcaugugccagaccuucauggagcccugaggagugaaugcugccggaaggucaccugggaaaccagauccaaaugagugcugucuccgcauugaggggcaccgccugcaaacagugggcuucccuugggcugcuuggaagacugucuagggguuuugcagauguauuuggaauuaagauggggaccugccugugacucuggccgucugugacuggaccaugcugccugcagagcagcccugcaacuuucaagguguggaaagcaaagggcaaagccaaaggggagcaacaauaugugacuuauagcccuuuauauacuccccaagaaucaagaaacugcccaagugcgggugcacuguucagggcucuucuuaggaagcaagcuaacccagagcaguugaaaauccuuugaaagucaauaaggagaaaaugacuuacagcaucagcugcuggaaaaguuaggagcucucaugacuagcgugccaacaggucaaaaaagcacgcgguccuguccucucucuguccagcuugcugugcuccaggaguguucugcucaggguccgcuuuucucuguggaaguucuccaucuguaacagccuuucuguucaaacagaaacugaaauagcuuuggauucuggcuuaaaaugacgucuccucuggaucugccuaccgccccgccacaaaaggagauugcuuucguuugguucggauugguuugguauggugugguuugguuugguuuuuggcauuaggcagagaauacuuuuaccaaugugauuuuucggccugggcuuuuaagacacuguuugccacgugaaguugccuuugcugugugacagacuaugcaguggcuacagucuuccaggcagacaugcuuagacacuguuuuaaacucuggaugcuugcucaguagugaggcaguagaguucuccuuuugacguugcaaagaccauaaguauguuuuagguccuugucuuccuuuuggagaaagcauucuccuuucuccucauucuuacucugucucugacucucccacccucgaucccucccccuggggggggggggcgggggggagaagcacuauuuaguuugacuuugugaguugagccacagauuuugcuaggauguaacccagugacugacugaguccaagaagcaacacucaccaucuauuccuuaugagguauacuuaucuuaccugaugcugguuaguuuauaaagaaaauacuuuuucauaguucuggagacagagaaguccaaggauguagugucagucucuaaggagggcauuccuauugcauuauggcauggccaaggcaugacuugcugagcuugccugcuugcucugucugucucugucucugucucucucuauauauaagauaaaggcacuacuaccacaaugaugucccacccuagugacaccauacaauccuaauucucucccaaaggccuuaccuccaacauagauuagauuugguuugguuagauuuaguuagucuuaccaccacaccauaaugacaauagucaaauugcaacauguaauuuuuguuucagagguacagugaagucauaguaguaccuuuauaugaggagauuggaguggggaaagguaugugaagagagauaguggagggguacauugaagacuaauaaacugaaagcauugugaugcuuguaagguggacacagcacagacccccagcugggcuuuuucuccuuguucuugccauugguccccugcuccuccucagucaggcacaguuccugccaacagagauacucauucuuugaaaacuggaacuuccauccaaacuaugaggaguccugaguucccuggccuaucuuugccuuuccugaaagguagcaaggcaugggagcaucaugagcauccuccuugcugguuaaccugaggacaaaacagaaggcauggccagccuuggugauacucugcccuugggcuccugguaccaugguugugucuggaaagucuuacaaguacauuaucaggaaaccggggagguggcucagugguuauucacacguguugcucuuacaggggacccagguuagguucccagcgcaaacauaauguuucacaaucaucuguaacuccaguuucccagaaaucugacauccucuucuaaccucuggguaccagacguaaaagugguacauacacacacacauaaaguagaauguauaaaucuuuauaaacaaauacaugugacggcccugaguauuacauguccucuugccuuggaaagggccaaauugaggaggaggaggaggaggaggagcagcaggaggaggagcagcaggaggaggaggagcaggaggaggaggagcaggaggaggaggaggagcaggagcaggaggaggagcaggagcaggagaaacaggaggaggaggaggaaagaaaaagaagaggaggggcaggacggaggaggcuucugcauguuuaaguacugggcaggaugcucccaagauuagccacgagucuauuucaaggcuuauccacacacuccuccauagagugcuugguuggguuaaugaaaugagaaagguuccuuuggagguaggccacuagagccugaagacaggucuuguuggcuuaguuucgaacuggggaagcccauggaaauccuaggugugguguuucaaauaauaugaagauucuugccagagagacuuacggacugauagcaaauggcuuuuuaacucuguucuagaguuuggacuacaguugaauacgauguucggaaccuuacuccccaugggcucugacagucacccagagcaccuguuaccucccccuucccucacuggccucuguguucccaccaguguuuuccacugccuugucuaaugcuuccauccuucucuucugcggucucguuacuucuucuucccacguuggacucggaagcuuuagcuugcucgcuucucggagcuuucgaucaugaaaggauucacugacagaagcaaucacgggcuaaagggaaauuagaaagaacuuacuaaaugcaaggaccaagcugaugugcgaggcuuguuuguccucucuuaaagaaaugaagaggaguuuuaaaacguguggccuccguaugcacgcugacccuggaccuguccuucugauggcugacacaggacauguuguagcuuuucugacuguuucaauaagguuuuguuuuuauugucuucgcugauuaauggcaaggaauagaacggucucaugggcaaaaucaauuugcuuuccuucgugcccuaguucacagcuuccguuuccucuuuuuaagguuggacugcccuuuaaccaugccugugugccccuccucuggaguggcgggggagguccccuccuuuccccccauggugcuguaauuggaaauuugguuacugcacuaaauuuuaaguuuuggcacucauggagagcagccauccaucugcuggcgagacgcacugcccggggcuuuucaagaaaucccuuaauaguccugaacacuaauaauauuuauauacaucgagaugagacaaaauuuacagcaggcuucugaagcuggcuccaggacugucuaaucccagcccugcguucuccugcuuccuccuggaauccucugugcuggagagagagccacaccccuuuccucccuguagccacacacagaucucuagagucaguccccuagcaagcaggucggccuuccuccaucuucucucucccucucugcauaccccuuuuuuguccucuuccacccacagaauaucagaugcgcauuuguucacaguuggcaucacugaguguuaagggacucauggaucugguauaugccuuaaaagaaccguucuaucuguaaagacaguguuuuuaacuuuaugguucuuaguugagaagaaguucccaucacaggccuggaacagggcucaacaugucucaaauuuagcaaauccuuugucaaggauuucuauuucucuuucucauccuggaaagauguagcauuugcauuugggggguaacugauucaagacaguguacaagguuauuucccccugcuuuuauaugguaugggcuuugacuacuauguagcuauuugacuucaucaucuauugugauguaucauuuucuuuccuauguaaguaaguaaagggcuccaaaguuggcaucuaguccucauugauaaucucugcugauaacgucgagcuaacgaaucacagagcaaugguguuggcggauggcugggacagcugcaccagggagccuuuagcgaguuacauugaacuuuauguaucugugugagccauagauggacaguguaaucaguagcagauuccucuccucuggcuguucuucugcccuucugcccacucugguuaucaugccuucgcuauacagcaugcugaccuuucuagugugagaaccuaacccuugccuaaagcagggugauuuccugcuguccgucaaucggugugccugugguaccucccugagcugguccauuuuguuuccagcaacaucucagccuguauuuacaucugaggaccucugugacgggugguccugaugccccuccccaucggccuuccuuuuucagugccaaucucacugucucugaagacccuuccaggaacccacaguacuaggaacacccugugcguggucuuuccugcuucccuggugugguauccuuuccuugaggucagggacugccaccguacaauuguacaggauguccaguugccuggcacacaggugcagcguuuauccaguaaauucuggguggguacguaaaugccaacagaucguugacuucugucauugacagauuuaaaaaaaaaaaaauuaacacaaauaacuucagugcucauuuagaccccaaaccuugauguaacccgugcagugcauauguuuaauuaagucaucagacuaucaucuucaacugugucauauauugauguguuugagugaaaaaagaaucagugguagugugugaagcuaaaaacaugguaggcuguuaaaucagugaacuccauuuuacugucuuugagguaauugcugugguagacagugucugaauucugauauuaggggcuccugcagguuuuuguuuguuugguuugauuuuugguguuuuuguuguuguuuuauguuuuuuguuuguuuguuuguuuguuuuuuggugugaccagagauaauuaacuucugcuuguuccugagcuagaauggguguccaaaaacagccugaagcuaguuauaauaaaugaaggucauaaaccagcugagaaggcuuuccgucuucacuuguguguggcucugaagauaggucuucuguguggaugguucaguugcauagauaaaaguugguuucucuucaccugaagaaguucaaaggucagcagcugcaguguuagucuagagcagugguuucagccuucuucaugcugugacuauuuaauacaguuccuuauguuguggugaccccaaccauaaaauuauuuuguugcuacuucauaauuauaacuuugguacuauuaugaaucauaauguacguaucugauacccauggugucugauaugucaccccucaagaggaucacgacccacaggcugagaaccacuggucuagagacaccagccaucuugagaggccaaguugaacucacuauguugccucauguuccaucugagauggcugcgugaauaucugugcaucauuucuauguuucagccagcaagaaaaaaggagacacacacuguauuuuuaaaggaguguuccaggaagcucuaguaaaacuuuugcuuuauagcccaugggaugaacgaacuucaaacacagagcagccacgcucuagccacaguggaggcuaggaggccuuggagccaaagagcauacccagcagaacaccuaaaacuccuacagggggagauaaccagggaggggaaaugccccgauguuucuguggagggaugacuuuagagucaaaugcaagauuaugucgauuuggcagugucacgagaacuccggucuccuuacugggucaugcugcugauuuaacuguuuuuaagggcagugacacaggaauucuuggaugugacuuagagcuguguagacagacugguguaaggcuccagagcacauacugacuccgugcagucaguucugaaaacugaucccaguggcgugcagaggugcccacaaagauggccguacucauggaacaguaaugugugggcauggagggcgcguuugaugcuggggcacagcuguaacggugagacguagcgagauugcuguauggugguauccacuccaagucuauccagugcuuucuccguaguccaagguuuaacauucagguauguguagucauacaccugugcacaggaagaacccgggaaagaccacgucaugaaggguugacaaagcggcuguuuugggugcagaugaacuuguguguucuuuauguuaaccugugguuacuggggcuuauuuggcuuaguuuugguuuuagaguaguuuuuuuuuuuuuuaauaaaacauggaaucuugacucuuugguacaucacaguuaaaauauacauauuuauguaguucuguaguauuuccaaacaaucccuucccccaauuggguacauguacuguuagccagauuuguuuguuuguuuguuuguuuguuuguuuuauauguuguucacaaguaaggaucauaggcguguguucaucaugacauauuuacagaagugcauagcagaguaccuguucagggugugauuuuagaucugugauuacuggaccuggccuuuaacuuaacaaggcuuauagcagguggccccuggguacagaaacccuguguacuaccauccuguaccguccagcagcuugcuugugaucugaagguuguguugugaagagacguugcagaugcgggcauuaccaaagaccuucuauaagcacugggcacuucgauuguagcuuguuccucuuuagagaccauaauuacuucugugcccauggcaaagaguagucccuccguagccuggauuucuuuuucuggaguuugagaagagagaggccacagucacgcagugcuuuuguaaaggguaugguuaacauuugcugcaguaaccuagagguuuugacuaguucccuguuuuauuuggaacuuuccuguugcugugauaaaauaccuugacagaaaaauggagccagagauagagguuuaucuugguguacaguccuagaggggacagaguccuugugguggccggggggaggggggaaggaauggcuuuagucuugucaggcaggaaacacaaagugaucgcauuccacccacacacaggaaauagagaagugggccaggcuguaaaaccccaaacaaacucuacccccagcaaaggacuuccuccagcucccugcuaaaggcucuguaaccuucccaaacagaccaccaccaccggccugguguucacauccaugaaccuguguaggacauuucuccuucaaaccaccguacuuguuaugccuccucucuucaucacuuuguaugcaugagggagaagggggugugcacaggccaguguucugugcgugguucaggcauccacuggggucuuagaauggaauucucauacagaaggagagcugaggagcacagugccuuguauaguccuagaggcccauauugucuguauuucucucuguucaccaguaccaugggcucccuuuuaauggguguggccacugcauuuugaagaguccauggguguuaaauguuaauggcucaucccauagcaaaccaggagucuaaaggagagaauggacuuggguuggguugugucuuuacccaaguggaauucacagacgguaagaucuacgcagauuucagaggaggugugcuuuucuagccagucuccgguacgccacgcuggugguggcagcggaugacccaggggaggcuguguagcccaucauccuuaccacccucucucccucuguccucacagugugcccaagugugugcgggaagcgagccugcaccgagaacaacgagugcugccacccggagugccugggcagcugccacacaccggacgacaacacaaccugcguggccugcagacacuacuacuacaaaggcgugugugugccugccugcccgccuggcaccuacagguucgagggcuggcgcuguguggaucgcgauuucugcgccaacauccccaacgcugagagcagugacucggauggcuucguuauccacgacgaugagugcaugcaggagugucccucaggcuucauccgcaacagcacccagaggucagcggcucuugucccuaggcccaggaggguucucugcugcauagccccuaaguguaggaccucccagggguucacccagaugggucugucagagggugauggcugagcuuguuuuaaugcgaaucuuggaguggugggucuguuucagcuugcuuuuuuauuucuaaacuuugagggugccuugcuagcacuagagcguaagaauuagcuugcuggccaggugcucccgagccuugcuccccgugcaccugcaaagcugaagcaugagcgguggagacuuuaacuacagauacuccuucccagcuugcuacucuaggccagugaaagcuuugccucucagucugagagagagugaagacaacccucaccagcauucaugaggccuggaaacaggucucccaugucucauugcaagccugggcucugggcaugaacuaguagucugaucugccauguuuucugccagaaccuccuuucucuaagccuuccaccaucuuuguggccucugguuuuccuuccuggacucugaggcuucacuguggaagcagagcuguuucugacugaacaagcuguacuuccacaaacucgucaugggugauguucgugaagacaggauuuuauaacucuggaaacacaggacagucagaggucugagguuguuguuuccuccccugaacagagcagaggacuuugggggaagguuccauuguaauucauucccugccuccgguacuguacacacauacacauuucugagccucugaaaauacaacuaggaaguucugaauacugcccacacuugugagaugcccuggauccaguccccaccuuguagaagguccuagauccaaucucuggcacauagaaggaccuagguccagucuccagcauugcuaacaauucuguaaguauauaaaauguauaguuuugcuacagucacucucuauaaaagauguucaguacaucuucaaaaagaaauuccauugcugcuauaguauuuggagaugucucuaacuguaagcugacugcuggaucaaaccaaagauuacauuuucuuucauaauacuaagaugaaaaguaaauuccuaccuguuuaauuucugcaccauuaucacaguaaaaaggaaaagaucaaauauuuuuaaaugauuugguaagccagggacuacaaugacucagaauuguauaauacagucuacuaaaaauaagucugccauuuuuuuauucauguguuggcagucucuguuagucaacucucgguuacuguaacaaaauacuuagggugaucaguuuaugaagaagaggaagaggaggaggaggaggaugaagaagaggaggggggagguugguuuuagcucuuggguccauugcuuuuggcaugugccaaggacagacaggccuucuaguaaacccuaccuuguugagcuguugacuaagcuguuacuagauaagccuuuagaggcccuuuacaucuaaauaaucacuuuuagcauagaaaagggguguauguaccccucuacaucuugagccaaagaccuuugucuggcagugugaaguugcuuacccacaguccagacaaugccuuccuucuggggcugggagcagcaagggagagcuggcugguaagagggagagcuggucucuugugagacuaugccaggggccuagcaaacacagaaguggaugcucagagucagcuguuggauggaucacagggcccccaauggaggagcuagagaaaauacccaaggagcuuaaggggucugcaacccuauagguggaacaacauuaugaacuaaccaguaccccggagcucuugacucuagcugcauauguaucaaaagauggccuagucggccaucacuggaaagagaggcccauuggacuugcaaacuuuauaugccccaguacaggggaacgccagggccaaaaagggggagugggugaauaggggaguggggggguggguaugggggacuuuugagauagcauuggaaauguaaaugaggaaaauaccuaauaaaaauuaaaaaaaaaaaagagggagagcuggccaucaaacucacuauaucauauuugaccugcaaguuuauuuccucucccuacugaaaggcauucaacuguccuguaacacacagugaggaugcugugucuucauaggaguugggucuccuucccuccagugugcucuuaaagcacugggcugcugcucccugcccguucucacagucucucccauuuuaaauuaaaauacuaucaagaaauaauagcugucccucugcuggccuuugaagccuauuuagcacuugcuugaaaguauuuugaaaauacuguuugugcucugucuauacaagaguggguuuuaggaaacuuaagcuauaaucagaacacacccuuauagacauguuuucaauugcuaaaugauuccuagacauuuuaacaaagcgggagguggcuccagguuuuccuauuuggauaaaaaaaaaauggggaaagaauaaacauagucauguugacccugaacguuuauuucauguacuugucuguagccucuuuguuuguaauaccaggaagugaggacaacucagauaucugguacaauaaguaggaaagcaggccuccccacagaacaucaccaggagagguaaaggaagguuuaacuucaaggguguuguacauugggaagcacaucagccucagaagccaugugcuauaugacugccuuucuguaacauuucccaagguggcaguagaagacaccuuggcaguuaccgggaguuagggauagugaagucuggggcaggucagagggcagcuacaaacaggcaacacacaggaggacuuuguugaaguuguccucgaacucgauugcaguagggaauuuacaggucuauguagacagauggagaaaugcacagaaccugacacgcgugccaggucacuguguuaucguuauguuggauguagcagcaguugggagcguuggguggaaaguacacgggugcucuguacugucugcacgggucuguguaugaagcugcaguuauuccaaguauguuuuuguuuguuuguuuguuuuuagagagagcuggguuuuaugcgucauguaguuaaaugagaaaaacacaaacagagcacaaagaaaguucagaaggaaaccccucuccaggcuagaaaugagagcugucuuaguuucuucucuagugcugugauaaaaugucaugaccuuagcugcguauacagaaguaugucuaauuuggcuugugauuucaaagggcaggaucccagaugguggagugaaggaaauaacugagagcucagcaccagacgccuccuaauccuucccaagcaguucuguuagcuagggacugagccuucaaaugcaugagucuauggggccauucucguuccaacaccacaagcauguugcaugugguauuauaggaagccagaugucccccacuuuggcuagcuagguccacuucccaugggagccugugaaaaccucagccccacucuccuaauaggaaauaggaagauaacagagaacuauuaagguuuuuaaacaaaacagacuauagauaguauuuugggaacggauggaagacuuuaguaaaggcagcucuugcuuuacccugauuuucuuucuuuucgugagguuucacggacucauuuaagagcaguaauuugaauauaacacugucccacccauuccagaagauugggucauuuuucucauucagaaaucgacccagcuucucggcccuuauucuguauacaggcuaaggucucagaagguauagccccaggcuuagcaucuucucugccguuuccuaaaugaugggcaggaagcaggaagcaugccacugcuucuggcuccagguuguguguggcacugaggguagcauucggacaaggaccucauuagagagcugcggagguuccuggcuuuuauuguaugugcagcaaaacaacauuuggaucaauuuacaaguuucugcaaagcacugucaagauauaaauucacuugugcuuuagcaagaaaauaauggaccugcacugcgccagguaccuguuggaaucucucccugggcuuugggaauuagacuccuguuagugacaaagaugcggcugucccuuccccagcgcugccagcuugcccaaccuccucuggcaugcaggcaggcgagggucucaucagugagcagcuccauuuauucagagccccagagugccugugagucugugucucccagguagaccagcuggcuccccagccacaagccuaugauacccacaugcuucuugcaugggaaguguauucugucuaaaaacaagcgacaugcuuuccucuucugcagucuguguucccucuguguguuugcagcuuggauggcuugcccuggguaggagauuauacugugugauuguuuggauguuucagccugguucuuucaugaaaugcugcuguaauaacaaacaaaaagccuccuuacuuuucuguuuuguuuucuuuuuuguuuguuuguuuuaaugcaagaagauaaacucacuuuugugguuuugguccacucuuuaucuucaccagcauguacuguauccccugcgaaggccccugccccaaagucugcggcgaugaagagaagaaaacgaaaaccaucgauucggugacuucugcucaaaugcuccaaggaugcaccauccugaagggcaaucugcuuauuaacauccggagaggcaguaaguacuccaccccaccagaccaguggcuggaccgcuucuugguuuacuugcgucgaugcucuuccuggcucugucccuuuagucacaagcagaauacaggcuuagaaaagcagcacgggauguaaguaagccucuugugugacgccuccccugugaguuucucggaaacauaaaauccagauagaaagacagucgauguuugagccauuagcccagaauauacuccuguaaagaggaucagcccucgucuuucuuuaagucacaucuuacgcaggaaaggccuguucucucucucucucucucucucucucucucucucucucucucucucucucucucucucucacacucucucacacacacacacacucucacacucucucucacacacacacacauacacacacucacccucucacacucucucucacacacacacacacacaccucugauggcucagacccauggcuggcucaugcuagcugcugcagaguccacacuucuguaaggccagaguuuggguugcuugccuccguugaggagacugagcaaaggaaagauuaaagagugaucuccuguuuuaccucucagagccagaaagaugugccauccacaccucaagcuguggucugagccugcagacucccuuucuucacuugguguagacagcgcuccugggauguugcuucagaauuguauucaugaacaacaucucccaugguggcagcagagcccuguaaucuuaucuucucuagucuuggacugacagagaaaguccccuagauagaugcccuucaguuccugccacuagaacuucuagguugagcuacuaguaguuucaugagguaaaauacuauaggcagaagacuauuauuuuaaucuuuacugguaaaucuuuagggaaagaaaguuuuucuuuacuucagagacaaaguguccucuuuauuuauaguggauugcuugccccuaaguauuuguuaaauaagugaauuauauucuuagucuguagagguaauagaaacaagguggguuuuuuuguuguuuuuuuuuuuuuuuuuuuugguuuaggguuucuuuuuguauguaugguuuuggauuuuuguuuguuuguuuuuuucuuuaugggguuuuuugugguagugaguuuuugaggcuugggcauuugucuguuuguuuguuuguuucuuuaagauugauugauugauugauugauugauuuauuauauguaagugcacuguagcugucuucagacaccccagaauagggcaucagaucucauuauggauaguugugagccaccauguaguugcugugauuugaacucaggaccuuuggaagagcagucagugcucuuaacugcugagccaucucucgagcccccaaguccuuaguuuuuauugcccauucucuacccuuccacaauggagggcccuguuccccacacaagaacgcugacccuuauguuaauaaccaaauuguaguuuugcucauaccagaucuauuaauuuucuuugaguuuauugaucccaagacaugccuuuuaaaauucauaaaccuuacuguuuuuauaucuuccugucaugggagaucaaugugauugggaaauucagcccaugaagaagaauuacuuacuggguguggugacagacaacuuucauccuagugcuucugaggcagaggcaggcagaucucugaauuugaggcuagccuggucuccacagugaagacaccuuucauccuagugcuucugaggcagaggcaggcagaucucugaacuugaggcuagccuggucuacacagugaagacaccuuucauccuagugcuucugaggcagaggcaggcagaucucugaacucgaggcuagccuggucuacacagugaagacaccuuucauccuagugcuucugaggcagaggcaggcagaucucugaacucgaggcuagccuggucuacacagugaagacaccuuucauccuagugcuucugaggcagaggcaggcagaucucugaauucgagacuagccuggucuacagagugaguucagggcggccagagcacuugucuugcacacagggguuauagauucaauucuuggggaacaaaacacaggcuuagccgcagccacucuuuuuuucagguugaauucccuguagcccuuacauacaacuagcacuguauguauuuugcaagugaggggacucugugaggcucagacuuaguauaaggcuuuuguccucuucuuuauaucaaaccauaggagaaacuuucaccaaaucaaccuucaagaaucagauauaauaaaaaucccauucaccuaauuuauuauagucuuagaauuuugucaugaaccaaaguuuauguuacuugcuaugugaaagguggguaagcacgauaaaagaaauucacuggcucucgguccuguuacauuagcaacuuuuccuggcaacuuucugguuacagaaguaauuaugagcaggauagaaaacuuagagaugcagaaauuauuuagagagagagagagagagagagagagagagagagagagagagagagaacaaaacaaaacugccugcaggccaggaauagggaucagggagaggaagcaggaagaucaggaguucagccucaucuuaagucuagcauacaugaaacccugucucgauccaggguggggaaagauagaucaacuaccugcaugcaucauugcugugauauuggaguguuuuccugcagcccuaaauggagucuuuaaauauggaacuccagguccagcaaagaccauucuuaccaggcugggacagguuugcccaguccugccauggcacuguggagccaggacugccugucacugagcauaucuaagagauguugccuccauuugucagcuggggcuaauuagcagccuggcauuucugauuucacguucuguuaaucagcuuggcaacugcagcagccagccuccuagaagucugcuuucccgccucagaggccuugucccgguguggcuugcggagaguggagacagggacgguuggugcuaugccagccuucucacugcaauucccccacgcaagaccugcuuccccuucgcauccacaccagugugugugaaucugaguauagugcgccaccugaccagaggaagacucggugacauggacuccucuuucucuagauaacauugccucggaguuggagaacuucauggggcucaucgagguggugaccggcuacgugaagauccgccauucucaugccuuggucuccuuguccuuccugaagaaccuucgucucaucuuaggagaggagcagcuggaaggguaaacacuccauucuccuuucacagaacuguggcgugcugcgucuuaauaguguuuguguguguguguguguguguguguguguguguguguguguguguguaugugugucagaauacaacuugugggagucagucucuccuuuugucaaguggcuccuggggguucaacuccacucguuguaggcaccugacagcagcugcccuuacccuuaggggcugagccagcucccagccccgauuaguguacuuuucaaauauccuuggguuuguuacgcagaaugaaggugaaacccugggccugcuccugcugccuagguggucacccaccuuccugcucuaaguccuguggaguugucacaggauacuaacaauuuggcaaaugggugucuucauucuuaaggugcagucaucaaggguugcauaucguaguaguuacacuuuuuguugccgugaugagacaccaugaccaaaaugccuuagggaaggaggagcuuauaauggggagcauccguaacggugggagaggcauggcaauaagcaggcaagacaaaagguuagagcucacaucucaaacugcaaacaugagacaggaaaugagguaaggcccugaacccccaaagcccacuccuggugcacuuccuccagcaaggcagcaccucccagagguuccacagccuccccaaguagcaccaacuccuggggccguucguucaaaugugugaccccaugggugacauuucucauccaaaccaccacacgagucuaagcuagggcgcugaguucuagcaguccaagguauucccagggaaccuuuccugcaggagugacagcagccugccuguggugcuuaacucccagggaaauugugauucaucugacacuuaaccugccucagccuacugugcucuggggugugugugugugugugugugugugugugugugugugugugagagagagagagaaugcauuuguaugcauguauauauuugugcacacccucuggagguucaaggagacacagggugucuuuuuucucuaucuuaucuuuugaguaugucucucaaugaacguggagcucaccaguuuguagacuaacuggcugacaagccucagagaugucccuguguccacuuucuaagugcugagauuucaggcacauguuacguggguucucuuguacagcaagcacuugagcaccugacacccaagccaucuccuuuucaaacagagaagcagaaagaauugcaaaguacggacaguucauuuuauuacagagauauuucagcuugcagagcuuguacauugauuagcuuacagcgucuguguauugaucagcuuucaggauuuggaguauugauagggguugugccuucugcacagaaaugcuuugcaagcuggguuuuaaagcagccguggguuucucagcagagaguaaagcuggugcuuacugcaugugcacacagcuucuuuccagacucuggccugugugcccuugcuggccccuucagacauuugcuacggcucugguguagcucuguguuaaugcuuugaaguuuuauacguguauuaacuaagcaaucagggcccuuagaaagacagugacgggaagauccggagaaggcuuguccccaggcugguaugucuggaugagguuucuuuacaaccuccaguuuuucucacaccaacucuggccugggucuuccccugguacauacagccagaaacagagcugcucaccccguccaucuucccauugcgagcagagaagcuucagaaaaaccuccuucuccuugcgaauccuucugcaugugccagguacccugcccagagugucgcaaucauucuggggccucccguacaugaggccguggucacccuuaauucauuguugcuuguauuaaauuuuaaagugaacuguaacuccaucucguuucauuauguccccccaguagaucugugcccuauacucccugacaucgggaagcacguuuuccuuggcggauuaguagcugucagaucuguuaguuacuggaggauaagcucccccaccccuuuuuuccacacugagcaagcgauaggcauagaaagucaaaaggaggcuuugauuauuucuuaucaggauuauuacaugguaugauuaucuuaucauuaugccuuaacuaaaaguaucauacacuuagauguugcugaaaauugaaggcugguuuuuauuuccaagaauauuuauagccuauuuuuucauuauucaaaacuuagguaugaaguaccagccaagucuuuuuuuuuuuuaaaugaguauuuuauuuguuuacauuucaaauguuauccuuuuuccugguuuccccucugcaaacccucuaucccaucccaccuuacccugcuucuaugcgggugcucccccacccacccagucccaccucacugcccuagcauuccucuacacuagggcaucaagccuuuacaggaccaagggccuccccucccauugaugccagauaaggccccuucagcuccuucaguucuuccucuaacuucuccauuggggucccugugcuuagucugauauuuggcugccagccucuucaucuguauuggucaggaucuggcagagccucucaggagggagcuguaucaggcuccugucagcaagcacuucuuggcaucagcaauaaauagugucuggguuuggugucugcgugugagauggauccccagguaggacagucucuggauggacuuuccuucagucucugcuccacucuuugucccuguauuuccuuuagacaggagcaauucugaguuaaaacuuugaagauggguggguugccccauccuucaacggggguggggggcagucuaaccucuggauauggucuugacagguucuccuuccccuuuguggguuauuucagcuaaugucaucuccaugggguccugggaggcucuugcuuuccucgcaucugggacuuugugguugcuaccuccaguuccccauccccucuguucaauuuccugacccucuguacaucuccucuagcuccuucaauaccugacucugcacccucuuuuccccucccccuccuuucuucuucccaaaucccucccacccucuacuucccuugauuauauuguucucccuucuaaguaggaugaagcauccacucuuuggucuuccucuugagcuucaugugguccaugaguuguauuguggguauuccaugcuuucugccuaguacccacuuaucagugaguccauaccauaucuguucuuuugugacuugaguuaccucacucaggaugauauuuucuagauccauccauuugccugcaaauuucaagaagucauuguuuuuaauagcugaguaguacuccauuguguaaauguaccacauuuucuguauccauuccucuguugagggacaucuagguuguuuccagcuucuggcuacuauaaauaucagccaaguauuguuaaggauucugguauuggggaagcuucccuggaaagcugacgccagcccugcuguuagcauuugagaagggaguggagggcaggugaggccuggagacuuguguuaaaaaacaguguuucucagccuuccaguacugccacccuuuaauacaguuccucauguaguggugacccccaaccauaaucuauucauugcuacgucauaucuguaauuuuacuacuguuaugaauuguaauguaaaugcaugauaugaaggaugucugauauuugaccucaaaggaaucuaaacccacagguugagagccucuugcuucaaggauaucucuggccaggacauuugagacucuuuaguaguagcuuucucugguaacugugaugaaauccaaagcuuugaggggccacccauagcaacaacucaccuuugucucucguuguauaguauuagggcucagcugguucacuucuuccucacuuauuuaauaaaggagagaaagauuuguaauaagcagaugaacacagguagugcaaagcacaggcuucagagagccccagaggagaggacagaaggugcucuggguaccaaaaggaagacucugguggagaaggccacacaggcuucugagcaaagcuggccuggaaggguuugggggacuagaaagcacagggacagaagaggagagagcacagaaugacauuugggccugucuuguguucagcuccugggggagguaggcaguacuaggauuauaggaggcacuguugcaugcagauguagagguuaucauuuagguaagccuugggacgcacuggagauuuugaggagggguguauuagcagaguuaucugacauuuaauuucagggugcugucguuuauacugauagccuccucccccuccccccaguguuucccagaauguguggauacaucacaguuacagggaaaggggagcccuguggaacuucaccagguucaccucaccccaagucagacagaaaacuuggggugggggaguugccagcauaagcucgaguaacuuucugaguauuucuguguauguuuggcacauggcaaagauuagaaaugacuucgcuaucccugugauccuucaaauguauauagucccaggccacuucugaguuuuuauuuuauuuuauauuuuauuuuauuuuuaagcaaucuugccucaacucaguguugaaggaaucuauuucuugagcuuuuuguauggcuacugaaaauggcauaaaugcuuccgugcggcucaggaggauucugaagacuucugucuugauggaaagaggaauauuuccccccaccccaccccccacccccaugaagguauccuucagccuuagcuauccaggaaagcacugcaguugaucuuggccuucucgguagccccccgugggaacacaaguguuuugccuggcguguaguuccuguguuuucuuucugggccugcuuaccugggucaugcaugcucaucaggccacauuucuguacacugauuuccaggccgacgacaggugaagcagaaucccagcagagcagacaucagggugcacagccacagaacgguacuuggguagcagcaggacccuuuggucucagccaucacucucucuguaguguggcauagcuguagaaucccaacuucagauaagaucauaggaguuggagagaugacucccuagcuaaguguacuugcuuggcaaucaugaggccucguguuugaauccucggcgugacugagccuagcugcacccaggaguagcuccagguggugagcugagacagacugaucccaagaacuugcuagucagaugaccugccugaccugagccagacuccgugagacagccuguuucaggacagugggguagagaguaacaggaggaugcccagugucucucuccuguguccagaagccugcacgucuguguacucaaggacagacacagaaaggaaaggguuuucucagaaguaguggugugguguagugauagagcacuuaaccuagaguguguggugcuugcuaccugaucucuagcaaagugugggggucaugggggggauuaagaaggaaaaucaaguuuugucuggggauagggauaugugguucuccuugaauaagagagaaaauauuuccauuaucugaaaaaaaaaaugcucugcuuuggacaacuuugguuugggagcaaucaaauaaaugaaaaguucaagcucuuaggugcugccaaagauuauugucuugaacagaacaaaaauacuggaagggggccaguauaaaguuagaauucuuagucuguuuaggcaucucuacccuuugcagacucaggguuuuguaaugugcccugcaucucuggaacuagacccuaacauaaccacauuuuagcacauacuugggacuuuuaaaauacauacaauuaguuacuuugccuagcaagucuaggcuguuccuagagauauggaagcauguguaugcaaauaucacaugugaaugcucuuagcaacauuuuccauaguauuuucucaaaauggugcguuagauauaaucuagggguuccucaguauaagcgcaaaacacacaguaagauacuagccaaugguacauguagcauccugggugaacagacaggggaaaugccuuggaugggagaagaaugggggggggggcuucaguuugauauaaauguucugaaucuggaugauugaaagaugauuggccaucuguauaaauuuauugaagcccauggagcuguauauuuauagugggaacaauuuuagaagguaaaacguaccucagcaaagcuguuuuuaaaaagcacucaggaacaaacggccuauuuugucaaucuauguggugcuugguuuaguuuugccuggguauauauuuccauacuaacugagccuuuguagaugguauaacuguggaccugaagugaaccaauauucuacagaugggcuaaguaguguuauaaaugacuguacuggugacagcuucaguguacuggcuucugaugcccucuagagacagcugucacaggcaguaguagugucuccuugcaaaaauggauaugaguuauugguugucugugcuuccaggaugccaguaagagcuugaaagagggguccuguguaggcuggagaccuugagcucagcccugccuguaucaaggugcaggacuuaccuauuuucugugacuuuguucugggggacuuuugacaguucagagaguagcacaggucauccugugccuuugugaggugauucaaagcuuauaacguccuuuuauauuuagcauccaguucuucucaauuggccucggggcccgaagagaccagaaaagauagcuccaugggcagcugagaaccagcagcccuagagaagcugaguaaaccauucaggugccacuucauaagcaguggagaaggugcuugggccugguuaucaguuccuacauggaagacucuacacucgguccccugcagucuucacuuaaaagggaggccuagaaaugguagccacagaucauagcuaaguguuggcugugagcuuaucaugugacagggcccccaaauuguugacuaaccauccuaguaggucuaugcauuggcaggugaaacccauccaauagaggggauuuuuuuuucuaauguugaaaaagcuacaagcuaccaggcagugguggcacauuucuuuagucccagcacuugggaggcagaggcagguggauuucugaguucuaggccagccuggucuacagaguaaguuccaggacagccagggcuacacagagaaacccugucuugaggggguggggggggugcagaaaggaagguaggaaagaaggaaggaucgaacuaagagccaaaauaccacucaauaaaacuccgggagaucauacagcguguaggagccaaaggaaaaaaaaugaacaguuugguuuuuaaaaauauucuguggauguaaaaaggcagugagcuuagaaacgauuuaugaagucgcauuuauugagugguucccuuaacuagucaucucccugagaaaacaaugaccauucaaggacauuaguaucuugaagguguguagacaaaucuccaccuggggauaucucuuaacucucacuauugcagaagguguugaggaggcaggccucggguggggguugggaagcaggcacuguguggacgggcccuccccagcagguugauuauuauuuuggugaagguuuuuauuuuucuuuaccuucuguaggcuccacaaugccuggauuuuauugauauugguauucuggcucccagccuucucugcauuguuuaaagagagaaaguuuguguuuacugugaaaagauaaucuugcuuuucaaagugauuagucaaauacccugaguuucuaugugccugccauucauuugucaaauuccugguuucuaauucaugcucccucccuggggagaagaauguguggcucagaaggaagguauuuucaguacaauucuguuuccugcuugagaaauuaguuuacuaagaggccuuggccuagauggagaugggaguuugaccugauuaguuggcccuuguauccggccuggaggugucuucaauaacaggagauuuuugucuccugggacucucaagacuugggagcagccagaccggugagguuagcguugaggcagcaguuuaagaauggcccaugguuaggcaagacaccuaaugggacccaaucuuuccaccauuacaccuauccuucaguugucugccuauccugaccacccccauaucaauaagagugaacauuggugggucccguagguggcaguucugacugacagguauccaaggaccucccuaggacauacacucuuagguacuacgaucuggauuccuuugaucagggucuuuguuuccuacuccaauaaacaagcaugguaggggaacacuccuuaccaaaggcuagcggcucauugagcccgugcgugugcagacccugcgcugaagccugcgcagaagugcucaaggaggguuggggcuuccauucaacugcuuagcucacacuugagcuccgacuccuccaugugaggacucuuaccuaugagagggauguaugugcagaggucagaggacagccuuacacaguaacuguucuuccuucucgggguccugaucaccagacuugugauguaaguacucuugcacgcaugagccaucucacuggcucucauaaggaaucuuaaaaccaacgagaccucagacuucaccuacgcacaugaacgcugcucuucauagcaccgaggaaacugccuguggcuuguccuguggggaauucauggcucuuccgguccuggguccuggccucugagcucccuaaugaguucuccaggaagugucgggagaggcuuggcaacccugcagcuguaacucauuucucaguaugugaaggucauguugaaagcagacccccuaggcaguaguucuaaugugggugaggacucucagcagguggugccuagguggacacagccuuuagggcagaacaggacuuugggacauguuugucuggucuguggguggauuuagaaauaacuguuuaaaaaaaaaaaaaaaacuuaugcagacacccaaguagaauccuugcucuccccuuggcccccuaagauagcuaucuucccuuuggccaugcccauaucuccccucuaguggaaguuaggccuuggaaacagugccguggccggccugguaguuucuggguggacccaggacugguguuuaucagcauuaccugcuagacaucgagauuccuggugcacucuggaccucugcaccagaagcucuagcgguaggggauacugagaacaagcuguguacauacuaaauguggaaagccaccauguuacacgcugcaucuagcuacccugaugugagagcccagggagacacuggaugucuguccucucccacguacucagggacugaaaugaaggcuucuugcagcgagaggcaaauguacagagagccaggcugucucccaucccaucaugcacugcugauugggcauggguaggauuuauuccuagggauaauggcagccuuugcugcuaguauguaagcuguuccgguugaguagcggagcaugucuguucgccuguaggcugauuucaagcacauuguccauaccuggcucugagagaaauaaccaaaggcauuuucccagggaaugaaucaaggaacauccuuuggugggagaagcuuuguguguugguaauagaggucaugaaauuaauuaguguccagucgauuucaaaacauuguccuuggcacaucuuuuugccaguggcuaccgccacugucugcuguuauaaagccccaguaagcaagcaaaccccuuguugguauggaacuacacuggccgcagagaggcucucugucgccugagggggcugugggcucagugcguugcuaaugcgcauuucugugcuuccaggaacuacuccuucuauguccuagacaaccagaacuugcagcagcugugggacuggaaccaccggaaccugaccgucagguccggaaagauguacuuugcuuucaaucccaagcugugugucuccgaaauuuaccgcauggaggaagugaccggaaccaagggacgccagagcaaaggggacauaaacaccaggaacaacggagagcgagcuuccugugagugacagcaucucagaccccugggacugccacaguccagauaacagucuuuggcauccgugggcgggcucuuuguuucaccauggacugucaaaccacugcagccagugccuggccucugcauauuagugggcgggugccugauacacucauacugauauauuuuucuaaggguccauuugagucuauuaaacauccaagcagguucuuagagcuugcacaguuaaauaccuuuucaauaugagcaaacaauauuuaccgaagagccaguccacuccaggucagcucugccuuucucuccugugccauagaaggaucaggguagaugcuccacuauaauacuuccguggacguccaguguccuuguccucacacuuggccuccuuucucugcccugcuccuucuagaacaaagugagcccaugucuuugaaucggaaugcuuuucacauguuggacaaaguaauaauuccauccuggugaugagaguuuucacccuaagaucucauagccuagaguucaaccuguuaacccagccccucuccaaauguggucccagaccuggaugucagucucuccucuagcacuguauggagcuaggcaugaugguacacuccuauaaucucaccacuuaacaggcugaggcaggaggauugugaguuugaagccagcuugggcuacaucuaaaacccuguuuuaaggaaacaaaaacaaacaaacagaaauacuaaagcucuauuugacccuccgucauuauauagcauuaguggggaaucaggagcugugugaccaacagcuagucagacgugugcauacauguggggggagggcuagccuugucuuuugaguauccagauuuaucugauacucuacggauccaggaggcaucuugagaagaguaguuaggcagaggugguaaguguguacacagccagcacccucaccuuucugcagagcccccugaccuguuccccaucaagaacauagcagaagccugugaucggagcauuucaaagggcuucucccuuaggggcagccagccugaccugacaggucaugagugcgccagccauagauuugccuuuggaagcacagucaggguuuucucucagagugacaucacagagacggauggguuucugucacucauggaugugccucugugccccaggugaaagugauguucuccguuucaccuccaccacgaccuggaagaaccgaaucaucauaacguggcaccgguaccggccgccggacuaccgggaucucaucagcuucacaguuuacuacaaggaggcgugaguuugggccucucacucugaugucaagcuugaggguggggacggccagguggcagugugacuuggcugaauagagagucuuugguguaccuauaaagaaucaagucaggcgaccgucaccucauccucaugugaccucucuaguugucauauuaaacugucccaaccugagacagcagcuagucaggagagugucccgccucagcccuuucauuguuuauaugguguuugaguaaguucaccccaaggggaaaggggaugaauuuuaagagaacugaaugccuccaaacugucauaagccauuauguggacuugguuaaauauugucuuagccucugucccccaaaauaccccauggggugcucuguucucaccaaggcuacccugaacugacccauugucuuccagucacuugaugcaugcauggccuugccaagacuuugcucugggccaugagcccucuagcauuaaagaauagugagggacgaaccuaggugucagcaguuccugauaggaccauccugcuuacuccacaucacagcuuccugagcugucccauuuuccuacucagccuccuguggccaggugguuuccccagucuguguggucauccguuuucccaggcacugaucuuuccagaagcaaaggugcugguggcagugccugguaucuucgcugccacuugaccuaggguccugggaacuguuauagcccagggaaaauagaaagcucaaaaucacucaguguuuguguaaaugggggccaccccucucccaucgugaucgaacacaagucaugucagcauaauuucagaagccaguagcuagcagcccuugcaucucgucaaaguagacaccccgccuaccaugcaucugugcagagcccucccuucccuuugaaagugcugccagugcacuggcgaugcuaacuggugguaucaccaaugccacucucugagacaaucaggaaacaaaguguuggaauauuaugagauaguuaagcaucgaaaauagcuauuaucucagccaccaaacgcagacacuauugcauacaccagcaagauuuugcugacaugacccagauauagcugucucuugugaggcuaugccagugccuggcaaauacagaagugaaugcucacauucaucuauuggauggaacacagggcccccaauggaggagcuagagaaaguauccaaggagcugaaggggucugcaacccuauaggaggaacagcaauaugaacuaaccaauacccccugagcucguguuucuagcugcauauguagcaaaggauggccuagucggccaucguugggaggagaggcccuuggucuugugaagauuauaugccccaguacaggggaaugccagggcuaggaagugggaguggguggguuggggagcagggcggggggaggguauaggagacuuucaggauagcauuugaaauguaaaugaagaaaauaucuacuaaaaaaauuguuuaaaaaaaauagcuauuaugagccaggcagugguggugcacaucuuugaucccagcacuugggaggcaguucgaggucagccuggucuacagagugaguuccaggacagccagggcuucacagagaaaccuugucucgaaaaaccaaaaaaguaaaaauaaaaauaaauaaaaauggcuauuaucgaauuacauuuuagaguucuagggggauaggaaaguuaguuuuguccaaaaguuguguuuuauuaguuuauuguuugcauuaaacagcucugcuuguuuuuuguuuuuuuuuuuuucauuaguuggguuuuuguugauguuguuguuguuguuuuuaacucucacuuaagaagacaaugagcauccgcaugucuuagacgcagcauuuucagucccugugaaugagggacuugcugucucuaaggcugcuugucaguucugcgguucauagcugucgagcucccgaguccagaugcuugauuuuauuuuuguauagaaaucuaauugaugaugaguuuuauuuggaguucccaauagaaauagaaagugugacacguucagccccuggggaagguucuggggaguuuugaugccagagcccuucaacguucucuggccuguguugacugucuuucagaccauuuaaaaacguuacggaauaugacgggcaggaugccuguggcuccaacagcuggaacaugguggauguagaccugccuccgaacaaggagggcgagccuggcauuuuacugcaugggcugaagcccuggacccaguaugcugucuaugucaaggcugugacccucaccaugguggaaaacgaccauauccguggggccaaaagugaaaucuuguacauucgcaccaaugcuucagguauccacgcaccggaggaacaaccuccaaccccuguucccugaauuuuuauaagcuugcuuuauuuacauaggcacaguauggcuggagggcuagcaaugagaugcuuguuguugcugcuuaacacuguauuaacauucucacugccaacaccuuaaguucuccugagccauuuccuagacuugguaccaucuuaaaugucaacaucucugcucuacgcaauugaaucgguguccuccagagcaguaggaugguuucucugaaugcccaggauguagccacuuguggcuggucuccucucucucagugcagacuuccagggacugagacgacaaugaccggugcaccccuugccucuaguggcuugcuggcuuuccaccuuuauuccguagccaccagcuuucucaacaggcgaacgcaggcuuagaguacuaugauaucggauuauugacuaaucccuucucaucuucuucauguguuuacguacuaguuccccagcuccagaaccuagaaguggggaaaagcaaaggugugaguuuguauccaaagacgagagagguagaaagauaugcuucacuguaaagauaaugacugaccucuuacaacaaaaaauuccaucgacuugaguggcuuacaacacaaugaaacauauucaccguuccaagagcaaagcaacugaauacauuucucaucuuaaaguuugggaguaaugacucccagugaaucauugcagcagaucugagaggaaaaaaaaaaaaacuaagcaggaauuucuuaucauuauagcagauucuuaagaaauccuauucuucuuccuaaauauuaaaaacugcauuuggucccugaccucaaaagugcuugggaccgauagugacguacuuaguccaucaugugccucugcuucaucugggaaacuugucauugaaauaccuaguaagaaacuguuuuggaaauacuuauugaaaacgcucacgggaccaggcaucaagugcuugucuucucugcaucagucuuggucuuccaacguguugucccucagugguucucagagccuugagcaccgcauacauccuaacagcccucuguccauucgcuuccuguugguguggugguauaugaccuggcaaggaaaggauuugacuuccacaucaggaucacagucugccguuaaggaagccaggguagaaacuccagcagagacaggaacuuuggagaagcacuggcuugcucccaguggcuugcucagccugcuuucuuagagaccccaggaccaccagcccagaggccuccucaccacaaugagcugggcauuuccuccaccaaccauuaguuaagaagaugcccugcaggccugccuuacagccugaucauacugagccauccucucaguugagguuuuuuucugucagauagguugugccaaguugucauaagacugaccgguacaagcuuguuuucaccuuucagauucaaaaacagcuugguuggaccuuauucuuaagugucauaaccacgguucugucucuugcacuuuggaaacugccaaaaccagugggccucauucuuugccaugugcauguguguguguuggggauggggugcgcuucggcugugguaucucuuuugcuauggugaggacacagcagugguccugggauguuuuccuuuuuacguaaguuaguucuacuuuugagccugggcaucaguaguauguaagccuccgucguuuuguuaaacucauuugcuuguaacaggacuuugcauagaaucagggcucaggcguacuggcuuuccugaaucaugacuugcuuacaagaucugugagucccugcuccuuguuucacaguccuuucacccaggcacauaaccaccccacacacuguccaucccccacucccacucuucauuuuggcucccugucauguuuaucaaguuuuuaucagagauuaaaacuugcaaucacaggugaaguacuaagccguccaauuugccauuuccuaauacacaccggagaaugacaguugucauaacugaaucaacucuagguuuuuuuuuagaguccccuuuaaccccagcuaugcccucguagccccuucagucccaggucagugagccauguguguuugcacauagauuaucuaagagcaagugcucugagagagggcuggccucccaguugguaaucuuuccaaagcucugguucaccucaugcucugguugguccguugcuaucucugugcccaggucaagccugcagcuuccuguugguuugcaucgagccccugauaaccucaaccucggauuccggucuauucucugaaauguucuuuguucuucuuuccagucccuuccauuccccuagauguccucucagcaucaaacucuuccucucagcugauugugaaguggaauccuccaacucugcccaaugguaacuugaguuacuacauugugagguggcagcggcagccccaggaugguuaccuguaccggcacaacuacugcuccaaaggugagcugggggcuggcaggcagcaggcaggcagugccacuggccuugucuguugucugagagaaccugagccccagggucacaccugucacguugcagggcuugcuucucagcagugcacaccagcaccccuccccuccaccagcaaugcuaacaggcacuuccugcauggcuuucauucccaucucuggucuuccccaagcagacaaaauacccaucagaaaguacgccgaugguaccaucgacguggaggaggugacggaaaaucccaagacagaagugugugguggugauaaagggccaugcugcgcuugcccuaaaacugaagcugagaagcaggcugagaaggaggaggcugaguaccguaaagucuuugagaauuuccuucacaauuccaucuuugugcccaggugagugugcccuuuggaaaggcuacauuugaugccuuaggcugugcaugcucccaucugccccacgcggagcagcuccuguugguuggcaggcugcugggcugcuauugcagucagcugacaggaggcgcugcuguuuuggcuuuuacccauguuccccucugugucaugucuguuucuuugaauuuaaagaccugaagacaggaaacaaaucaaaaggugcuuuaaaaacuggaugcagugaccucuauccucacuaacuuacugucuguuugagucuugggucucagaccuacauucuccaacaccaaaccuccgucccuucauuggguuaucuauguggagcauuccaccugaaccaacacucaguaagaguagccaugagaguggccagguauggagcgucccaaagaggccaggcagagguccucccauacccaccccuauacugggugucagucaaauccaggacuccuguaggcauggccagagguuuaggucguucuuucauuguugcuaacaaauugcgugaugcuuaguggugugcauagcucaacaguuuuaaaguuagaagaacaaggagccaguguggcuuuuguugaugaaggcaucuuugggugugucgcauggccaaaguacuuauggcacagcagcgauuucagggcagacaggaagcugaacagacguugagcacuuagcuuguuugcuacaucaggaucucccccuaacaggaccauucccuaaagguuccuccugcagcugccccacuagugaccaaacaucuaacaauacagcaugagaaccaaggguagaccgaccauagcagaaagcccuugguguuuaguuauacucagaugacaucacuuugugacugcuguuaucaucagcuguguaacgcuaggcuaagugauugggcggcaaggcugugguugacccagaugggaccgugcagggcuuguacuguggguuugaaacgaauuuucucucggucacauuccuucguguaaguguccucaccucaguguccuaaaacagacccagcaugcagauaggggucaccacaccuggccauuaggguuugggggguuguuuuuuaccuccuaccgaggcaaggaucugacaucuauacgaggucucgcaaggucccauaaaggagcacccuagaugacaggagcaacucugucaucauacaaccgaguuuaccuaaaaccuauuccuaccuucaugucauucuaggugcacguuuaucugggggcugaaggcaaauauaucagauuuagucuuucugcauugucugacuuugccugugaguuuauaguagaguggaggcuacuauuuauaaaguuacuuccuaaacuugguaucaguaaauggcuuucauuggccgccaucuucauuuuugaagacgcuucaaaaauguuucugucacuaaaacauucucagauguuaaacaguacaaguuuuuccaguagcaucaggauacuuuauggaguaaggaaagcugauagugugcuguuugccacccccuggaccacucuguuugaaucaucccuagccuucugaugccuauauugccucccuucaugguccugacucuguguccacaguaacuguugaauaauaugcaagagugcaguguuuauaaguaaggaggccacugagucugcuuggugcuauagcccaguuuguugggggugggucaaggcaagaaguggaccaguaucauuuugcaauaaaucaaacacaagcaacuucuuacaugaaggcacacguuuguguugcucugguuugaaagggaggcaggaaauuuaauaauaauguuuugaacaucugccuagccgccacacacacacacacacacacacacacacacacacacacgcacgcacacaugcaugcacgcacacacauaccugaaaaaguaguuuccuuuaucuuuccuuccaugguuuguugauuggucgguuuaugguuugcugggugugagcaugguagaauaguacccucauuuccuaucucuuuccccagcauuaugauaacaaauccccauuccuaacuuuugagaugggcccugguauggcaguugauauacuuucaauggaaacuggcaugucaguacccgacaaagaacuaugguuuugguagcagauccaucugcugaagaccagggagcaugcggcccuuucccccaacucccuacuguacucucccagauguuggccuagggagcauccauaggccuugggcauggcuuccaaggcgccucgagcaccguacucuaggcucccuuuugucuuacucugucauguucuuaccagacgcagugcagucccaccuguuccucucauccuuuguccugucacaagcaaugccagcaacagccucaauacccagcuugcccacuguucaccugcagacaaccugaggguugcuuccagcccauagggcugcuuaucugaugucauauuuuuauuuauuuuuuuuuucaguuuuuaugaauguuagaaguuuuuucuggaagagagggagccccagacucuguuccuguugcuuuucuguaguuucuuaagcuaacacaagucagugaguaacagaggcuccgcuccuaucacagacaagcucacugccaaggaggaugcaaagccagguuugaugaaccuccaagaccaugcuguguacuagggacugggggcauucaucaauaggagacccuguuccucaggaaaagcgcugggauuuagguacuugcuagcugcuuaaacuagggcaucuucauuucagagaagaucaaagaagccacuacuguuggacuuugggucucuucuaccuugugugucuuaggccucaccuuucccaaccagucuuaugaggcugaugguuugucguguugaaugcucaguuaucaggccugaccaaguagcacugucugguaaaacagagcacugucuggcuaaaaauggcuggcacacuguuuccuagaaccaugugugcacauguuucucugaggaugucucaagagaguacaggauggguugugaaggcgaaaauccugguuauuuguugguucuuauccaaggagccuaaguaguuucuuuuaguucaaggcuaggacuuuccuauuacuucuacccuagccauggaaaagacaaagaaaacuaaagaacuuagcagcugaccuucuuucuccuccuugcaggcccgaaaggaggcggagagacgucaugcaaguggccaacacgaccauguccagccgaagcaggaacaccacgguagcugacaccuacaauaucacagacccggaggaguucgagacagaguacccuuucuuugagagcagaguggauaacaaggagaggacugucaucuccaaccuccggccuuucacucuguaccgcaucgauauccacagcugcaaccacgaggcugagaagcugggcugcagcgccuccaacuucgucuuugcgagaaccaugccagcagguacggcagguagccccgccgccaacuuacagccaaggcgggggaggcugacagcccuuagauucaggccuacgaaugugugguuguugguacacaacgucguccgucaggugccuaaggaacagagaauguauuccuagugccagcucccauccagacuuaaccauagacacucuuuacaagccccuuucagggcucucacuccuuggcuugguucacgaugcacaugcucacacccaccccugugcccuucugugcacagcugaaugaguuagcuuucuguugcuauuacaaaauacccaaggcaguugucuuaccagaaggaaagguuuauuuuggucucaguguuucaggaguuuuagaccacaggcacuugccucucacugcuuuggggcuugcaaugaagcaacacaucguauuucaucacuucuuucauugaagcccaaucuccuaaaguccugucuucucucagugccagaggcuacagacugagagcacaaaggccuuagcacaccacagaccugugaggggcccuccaggucucaaagcuugaugcagaggaagcguuguccucguggucagcuagaucagccugugggccuccuccuacaguuagauacugccugucacccugccagccauuugccacuucucauucguggaggaggugucagucaguggggagaacaaagcaugcugggaacuggggcaguaagagcuucugagaucggcuuuggcacucccguguagcccucagccacccgugccucaguuucccaauccuagaagagacagagaacagcuuaucuccccaggccucucucggcugucaucagcugucacccaacagcugugguucaccaccagaagugaggccagcgguggcuggaagagacaguggccggaacagcugccucagaggccagccucggaacuggcccuuccucccucccgugugagggugugggcugugaaugugucagugccacagcuggaggcucagcacgcugucgcucacugcccuuccccagggccgcucuguuugaaggguucuuuuuuuuuuuuuuuaacuuuuuagguaggaaaauggaccuggagaauguuacauagguuuuucaggcgugaucacuuguacuuggccacagguuuuuucagucagaggggauggaggcgcugugccagcagccaucucaggaaagaacuccuacaagguccccuguccagaguccuguauauacaaggauugggggaacaguuguucucaaguuagcacaccguuuaucauucuuucuggggaccuaaacccaauuugacugcuuguuuacauuaauuaugcagaaggagcagaugauaucccugguccggugaccugggagccaagacccgaaaacuccaucuuuuuaaaguggccagaacccgagaaccccaacggauugauccuaauguaugaaauuaaauacgggucgcaagucgagguaagagggauaccauggccugcagcugcauguguuucagcgcugagagcacgugcuauggcauacugguugucugcugacugcuaagcagacaggggagaaagaugggcagucgggaaggauaaaggucuuccuagcaacgccaucuuuauugaguaguaacuugggugcauggagcuggcuggacuucauacaaacaaugaaacuguagcuaggccuccagccgcagacuagacacgucuugaugaucuuuuauuccucuggaguuaccaacauauuugauuuaauuaccaacauauuugauuaccauuuuccaugugccaaccugaaaaccacuuuuccgguauccuugcuuccuuuauguugauacucuggacaauguaaggagagguugggcagcuggagucacagcaugaugacuugaguugacagaugucagaucucacccaugcuuguaggaaauuaacgccuuauauuuccauaggaucagcgggaauguguguccagacaggaguacaggaaguacggaggggccaaacucaaccgucuaaacccagggaacuauacagcccggauucaggcuaccucccucucugggaaugggucauggacagauccuguguucuucuauguccccgccaaaaguaagucuuauugagggagacgcacgguaaauuucaaagcuggcugggccagaacucagaagcccugagcuucuggggcucucugguuuucuguuagaacagagcuggcuggguugaggagguggcuuacuagggaaagugccugcuuaaagaucuaaguucaaguccuugacggaaaccaggggcgguagugugcuuccucggugcucaggagaucgacagucaaaguuuugcagaucccuagcuagccagaaugguccauuggugaccuuugcuuucagcgagaagccguaucuagaaaacggaggugucacgccagaaaggaagacacuugguauuuacucacaguggacacacaucugugccaccaucaccuuccccccaccccaacacucgcacgcacgugcacucgcacgcacaucccagagcugggaaggugcugagccuuggagccuucucuugugaguaacagaagaguaucguacaaccuagaagauaucuuguucucaucguggcucagguguggaggcauuuugcaaagcauugaguugaguaucaggucuccugccuggucggugagggugacccagcgcucagcgucuccccagggaucgucuggugucacugcuccgggacaggaaucugcaggacaacaucccagucagagucuuccccuccucugugcucuucaccauccaccaggaugcauugaaagauacucugugcguuauuuugcacagacccacccuaguggauaauguuucacaguucacagaaaccacugagugagcuguuaggauucagauuuaaaaguaaauguugugaaauguuaaaugcaagggcugcaugcuuguuugaccgaaaaaaaaaaaaaauugagucuuuuuggugaaauaauacauagugaauuuuuacgugucuuaugagaagccaaauuuuuuuagauuauuucguguucauguaauauccaaacaaauacaggaucaaaugugaauuccuuuugcacuccccaccccccaaaaucucagcucagcuuugaggcuagaaucuaggguguggggaacuguuguuuccuaaugucuuauguucuucguggucucuucuggauucuugauucagacaaggucucaacagauccagcaaucccaguccaaaagaaauggaaguuaguuguguugaaaucuacaccccccuuguuuuuuuggcccacuagucacaguagccaaacaaugaaguauccuccagcaggugccuggguaaaaaugugguccauauauguaauggaauacuguuaauagaaggugcagaaagggaaacaccacgugaucucacguauauaugaaauaaaucuaaaagggugaacucagagucuugcagguuaccaggggaacauaacuuaggggguguugcucaaaagguacacaauuuuagguagauagaagagugagcuuuauaacacacuagcuaugguuaauaaagcauuauugaauauugcuaagaaaguguuaccaccacagaaaugguaacaaugcgacuuaaugcugaugcugauuggguuaauguacacaugcuuuaagauauguuguaugugguaaauauguauacauguauaacuuuaugucaguucacacuucgauagcccaccuagccaguuccagauauucaaagauacgcaagacauucgaaaauccucaucgugacugcacaaagacagaaguaaauagaaccguaagcaggaagcuaggauucccuguaucugcugcuacugugucuagauugagagaugaugagacugagaguucugucagguagacucugaauuuucucauuuuuuucuggguagccuagcgucaucaguuagcuuaugugcuaacucuccauugugauguuacuguagcucuccgauguggcaaaacccagagaugauuagagggguggcccccacaguuucggggguugucgugcucugucuguugauucuauuacuuuugggcuguucugagacaaaaugucagaagcaggaagcacaugauggaaccaagcugguuaccuccaaaaggcagaaagggcccggguuucacaguucucucacaggacaccugcuuccagugaccugacuuccucuagaacccagcuccuaagguuaccugccacuacuucccaauaacgucacaggccggcaacgaagcccugagcaucucugccuugggguacauuuccgcuuaucuguagcacgucgugcuacuaagccaacacuggaguucuggaaauugggugguguucucugaaggagcagucuugacuucugaagcuaagugagucuggcuuuucuuaggagagggcauguuuguagcugccuuuguaaagcuaagacugcaaugccacuggggacucuuaagagguccucuaaugggguuucuccaguggaaguuggcacaucccacagggggauugaagcugcgugcuagcgcucuuggcuucugggaaauuuucccgguguccgacaagacgcaguuuagcacaguuuucuugggucuaauccucagagggggacauugaaagcucggcaucaccugcuguuuuuaaggaaaucuuggugcgugaauucuauuaaacuccucuucagacuucuucccucccgauuaaauauucucaggucuuugggcccuuucuugaaagccaguugcauagacaauuuucugucaguuuuguccuucuggauguguuccaguuccucugugucccuguugaaaugugaaacucaaaaagaacacagaacaaccugacccguagaaucaggaacacaaaaccacgaauucuccuaggggaaaaggaaagcucggagcuucucucuggcagggaggcgcacgugggaguacuuuuagaaacuggaaggugcugaaucccaucgauuuugaaaaagacuuaauuuuggcuuuuguaguauuucaggauuaagaauagaguuuagagguagaccaaccauuggugaguggcucgcgguccaggaacaugucuccacugaguccccagcuccuuuccaaggagacaucucuauacuguugguguguacuuggugugcacaugugcagaggucagaggacaacauugaagaguugauucucagguuccagggauugaauucugguugccaggguaacauagcaaguguuuuuacccacaacgccauccuuauuguguagacaugucaacuuggguguccaauaguugcuauagacuccuuauaagccugaaaucuaaagugcuuucauggaggcacuucgguccguuucauucccugaucugcauuccguugggcucucagaugaaagcucacagcccuucgcuucuucuucuccgcauacucauuuuuguuuguuuguuuucccauauuaacuggagucuuacugauucuuucugguacaugacgggaauccagccucccaguuacuggguugcggcuguucugagccagggcugcaggaaagccaggcucugacuuuggaacuugucaguuauccgugcaacccuggcaaaguuaggacgccucucugaucuugcuuauggaaaaggauuucuuccugaggucugacuggagcgaugcauagcaugccacaggagacugguacguucccuuaacuccucuagaccuggcagugugcagaggcccccaguguguccucagacacacucaucuucccaguacaugaauccguuuucagucuggccuuggaagaguucacugaugcuucuucuucauuguuuuaguuuuagccuuuuagaacuucugacaugaguacuguauuuacaccaucuggcuccucccucucccagcuucuuccaugcccaccucucucaguuccaugacuacuuuaauuauuguugcuaagcaacuugugcgcacauugauacauauaugucuauauacauauaugcauauacaccuacauacauauacacacaugcucugccaagcucauuuaguguuacugguacauguauguguuuagggaugaccacgugggauuggcuaaccuaucagcaagcuuaugccugauaaagacugauccuccuucucucucagcagccauuaacugcugguaacuucucaucuagggguggggcuucagagauuccccacacuucaaagcaugugaacugguauugucauuacgcaaguuuagguaaccgcguuguugggauucacgcaugcggguggugucuuacauaaaagguggcaucccucagcagacacccugggcuucuggaucuuagaaucguaccacgcacuuauuuugcaguguuccaugagcauuuguuguggggguuguggugugggucuaucaucaguugggcauggguaccccauggucagugguucccugcauuuugaccagucaugguuuucucuaauccuuuccaucugcugcagaaagaggcuucucuggcgaggccugagagcuaguuaucuguggguagaagcucacugcuucagaaaagugcuaguagcagguucuucucuaguguccacgacacuacagagagucagcuagguuuacagaaucgggcaagaauuuccucccagugcucaggccuucagugcacuuagacagcuguugguuguccccagaucaaggugccaguguuacauacugaggaacaucucaauauccuggucacugcugcaguucauaggcuuaacugcugaccacugacuccucucaaucugaagaauggggcggaaaccacuuagcuggaaccaaaccccuucaucauucaauacacucugcaagacauuccucugcacgggaagccguuucccuaggggaagcaacccucgcucccccaucucuucuucccccuaugcccagcguacauccauguuaauccaccuguccacagacugaguucuugaaucuggcagaauucucaggauuuucagagguguagaccugaaccccuggaggccauccugugguacuuaccacccagguacugguagcaaguucagacuugaauugguuuuacauauuuguagaacacucagagcaacauuggcagggagugucauccagugcuuuggggggacgggaguggcgagcaagcugucugugggacuuucuuaaaagauaagaauagcgugagcaacuaguaagugugugagugucugcucauuuuccuucagcuaaacuuccacaaaacuacacacaggaagggcuugccuucagaauuacuugcuguauucagaauaugcagugcuuuaaaggagugugugcuucagucuguauuuauuuaccuuucuccaaacaauucaguuugucugcuggucuugucccagcacuagaagacuccucgaagacuccucuugugagaugagggaguaaaggcuauuccagaggcgguuuuaucauccuuccaaccauacacagaaaugaagugagccaguuauucaccucgugcgugacgucuuccuguuucuuccuugucucugcagcgacguaugagaacuucaugcaucugaucauugcucugccgguugccauccugcugaucguuggggggcugguuaucaugcuguaugucuuccauagaaagaggugagugccugggccagcggaagacaguacuuguggcgcauuggcuugaugauuugaacuugaacauagcucgucugugggggaaaauaccaugcagacuggacagccagaguuccuagucagacauucuucagaggggaaaaaaggacauuuccuaaugacuaacagcaacaggagagggguugcuuccuucucuguacccgucgucugcuuucuggcuguucuagcacacagauugcugccuuguaagagcuucuccaagcaugccaguuuagcuucccauggagugggccuuguuauuuccagugaagcaaagaaacaaauguuucuuuagaagcucuaaucugaggccagggcaaaaguggaaagauuuguccucagauaccggggccuggaucaggagugcaggcaagggucccgucagcagugaucaugguuugcgucccuugcucaagauaacucgugagaaagaaaaaaaggaaaagaaaagguauuuacagaaauguauagagaugggauuuguugaccugguuuucaucuuuuuuuuuuugacagaaauaacagcagguugggcaauggagugcuguaugcuucugugaaccccgaguauuucagcgcagcugaugguaagcguccuggccaaggugugggaauaugggagcugucaggugcugacuggagaaaagcguugcguaauuuugagauaccuuugucccaggaucugccuuugguaccauuuccuucuugucuuuuaauaacaucuuuagcacucagugacugucagacauucugggacucucagaugccccaguagaaaccaggcucuggagaugccgguggccggucugcuaagcaguucaguuagccgcuugaaguguggcaucagagugaaaggagcauucuaauuacuaccgucuagucagaggacugcuguagccagccaggcauccugaguggguaucaacucaggguggggcugcaggcguucccuggccagugagggcuauauagcguuguaugaucuuggaaucccucugcuguucuauccugauuagggucauacagccuaugcacccauuuacauucccuuuggcaguaacuaaugaaagucauuuaauuaaauggcucagaaguucugacucggaaccuguguuuuagcuacuggucucuuuuuuuccccuagcgcuuaugcuuggcuucagaccuucuaaguaagcuggggagggguccucuccucgauuagcccuuggagcuuucucaugucuaucuagaugcaggcaaaaaaagaaucucugagaaggacuuguucaggcucccacagcugagccgugggaagucugcacaagggacaucccaagccuuccuccugaauccucaugaugugguguauggaagagcuagcugugagguugcugggcuauguagggaaucugguuagaugggggucugugcagcgcaggaguuuguucaggaggaauguuucuuugcuccagaaguguaaguagaugcggcccagauaagacacaguccgauugauuauccugcucacaugggaaaaaaaaaaaaaagagaaaacccuuuguaauuuaaaagcaccauguaagugcguaugguuuuacuaugguuucuuuaaucauuuauaacuggauuauguguauaguaaagccagucaagaacagccucuucugaauuugaaucaggugcagaauaaugauguuauuucuguuugcaaaaggucuugcagaguuauuuuuuaaguaggcauaugugcauacguuugugccuauaaagcauagaaaauacacuagaaggguaagcaccacacuugaaagcauaguuacauaguuacuuacggagacuaucuuucuccuaaaaacaaacaaacaaaugaagugaguuuggauauguaguuuagugauagagcauuugccuacgguguuccagaacggguucuguccucacaccaccaaaacaaacaagaaagcaaacgggcaaaaaucaagaaacuaaauaugcauuguuuauacaggccagccucaaacuccuggccucagaugaucugaacaccuugccuccguccccuaacuagccagaaccgugcagccauugugucuaggucaauaauuauaaaagagaaaagaggugccagagaaauagucucccuccccccuucaaaacaaagcaagaacaaacuugucacuacccaggucaacaggugagaacacugucaccucaucugcacuugguuuguuuggccuuuugacaagcacagcagcagcacaagccuuuugccucaaagagcuacaaagugacauugcaucugaaaggugcuuuaaaaacgucuuucucccagaguuaaucugcauguugcuguugucaagagugcacugagaaugcccuacaggaaagugcugauaacauuguacgaaguuuaugaacagcucuggcuggcaaagcugagguacucuggcuaaagucggcagcuggauugaguuuagaaaaaggguugagaccacuaacuucagggaccucccagggaauggaugugaugggcuuuuaacuccaugcucugcagcaagcaagccguguaguugauucucauuaaaagccagccuggauccuuagagguaauaaauggagacagugguccccauccuuacagagagguguuauaaagaccuuucccccucugcucuccucagcaagcucagccucugcagggucacaaguugucugaggcccauggaagacagaauucuaguugagaaauuaccagacauacauauuccaugaaauacaaaaacaugcacaggagccaaauguggccacacaaaccuggaauccacguacuggggacacugaggcagaaaaguugucaauucagggcuagcuuggauuacauagcaaguucaaggcaaguaugaacaagauagagcaguccuguccccaaaucagccaguaaguaagaguaagugaguagacagauaaguaugugucuuaguguucugcugcugugaagagacaccguugaccacagcagcucuucucauggaaaguggcuggcuuaaaggagcuuacagguucagggguuuaggcccauguuguaaugguagcaaacaugaugguauguaggcagacauggugcuauggugcuggagagggguuaagaguucuacaucuggaucaggcagcaaaaauagagcaagacauaggccugguauuugaaaccucaaagcccacccucggugccacacuuccuccaacaaggccacaccuccuaaucucugucagguaucacugcucccuaaugaccaagcauucaaaugugugagucugugggggccacuccuauucaaaccaccacaagauguauguuccauucuucaaaauacaagucaaugggguccccagccccgaauuuauaauaaacacccuucccuuaagacaucacuuagaaguaagggcuugugcucugagggugacugauaaccgugaugaccugcugguggggucucccaccuccaacugcagcucggcaucuaaaagcauaaaaacaaacacagccgugauuccccucccaggccugucucuaagcuagggcuuccuucuugccaugccugcuggccauccucuguuagacagggcugucaguaacucuguuagguuaugguucucauggagcagguauucucuuuccagaucuuacguauuaauuugauaugauuucaguucucgcuguacccacuggcguuaugggauggagccuguguuuggucuuucuuacuugccucucuuauuuucuuuccuucucuucccccuuccuucugagaacuauucguuuauuuauuuuucucaaaccagaucaagcauaaccaaaaauggaagcuggagaaggaauucuguucagguccgugucagggagguuccuggcauugcagagugcaggccaaagccguggggucacuacugagucccccuccaucccagcgcucacuucccucacuagagauccccuggaagggggcuccuaggcuucaccuguguuaggcaagaguuuggcuucuuguguuaaguuuuaauacuuucaugcauuccggggcuagagagauggcucagcaguuaaacacacuggcugcuuuucuagaaggacccugauuugauucccagaacccacgugccaguggcacccaggugcuaugugcguacagugcagaugcaugcagggaaaacagccauucacaaaauugaugguuuuaaaacaguaugcauuccacuaagucaaaucacuugaaaaacaacacagcacagcccugggauuaaacugcauuuuacagccuguagagcaccuugaaucaucugggauuugaacccuggguuucaucucccaacccugcuuuuuucuucaucaacgugugaguucuccuuccucucagguggaaaaggcaggcagucuguaucgucacuagaucucggugaaaggggcagcaggguguguuaaacuggauccaaccucugcagcuuccagaguuaaacagcuguauggaggaauauagggagacagugcuuguagugcacaagaccuaccucagcgcucugcgggggugggggugggggcuggccucucaucuccuuuucugcgguuucuuuugauggcugaggacucuucucuugagucucugccuuuaguguugacugaguuucucccucucagccaccuugagcuuguugucggacauggcuauggaagaaguggaaugaagugcgugaacugauagacaucccaggcggcugacacauugucuugguguuuugaaacacaaucugaagaugccuuuaguucagcagaccccaucuccaaccuccaugcccagugggcuggggugggacugcaguuuccuguugccacacccagcuaguagccauguuuuuuuaaguguaaaagcugaugagauaaaucuguuagaauuuucauuuagcccacaacauccaacaguuaauauaaaagcuaucuuuuuaaacuugcuuuaaccaagucuuuggaauacaaagcuggaaaaaaaaaugggcccagcaguugagagccuugcugaccuucuggagaacucuaauucaguucccagcaccucugugaagagaccucccgccaucuguaacuauagguccgagaagccaacacugucuucuggguuucccaggcacccaaacacggguggugccucacaucugugcaugugugugugcucauacacacacacacacacacacacagagagagagagagagagagagagagagagagagagagagauuuucacauguauacguaaauuuuaaaaucuuuuaaaaguuaucuuuuuuuacuuguuuuaagcaagucuuuaaaaugcaguauaugucuuacuuccagcacgacuucaagcgcugaaggccuacaguggggcuggguggccuguaaacuggcacccaggccaugcagaggauguuucucaccucuggcuucauccagggaggaggagauuugacccccuuugguccuuuccccucccacuguucuccccuucugaccuacauuuccaucccuugaugaagacaggcaaaacagaagucccacuuucuuugucucuuagggcuaauuugcuuuuuuuauuuuguuggguugggguuuugccaaggauaugaaaaaggaaccacuguuguuugguuugauuugguuuuccuaucuuagguuucuugguuuccuucugguucuuagcuacgaguaccacccucaaagugucauggaguccucagagauugaguacccgugcuggacuguuuguaccuugauguucuccuuggugggucuuagggaacagcaucuuguaaucucugucuaagggccguuuccauccugucuguuacuaguguacgugccugaugaaugggagguagcucgagagaagaucaccaugaaccgggagcucggacaaggguccuuugggauggucuaugaaggaguggccaaggguguggucaaggaugaacccgaaaccagaguggccaucaagacgguaaacgaggcugcaaguaugcgugaaagaaucgaguuucucaacgaggccucggugaugaaggaguucaauugucaccaugugguaagaagccaagaugagacauggacagaaaguauggacagaaaggaccacccuguauguccuuggccagcuacgaauuguugccuugcccucuucccaguggguaguuuccccguugcauucuugccacccacagacccuugaggugggagccucgcccucgcccucccaccagaacucugcuccuggcuacaggccccagcaccacccaguuccgagaggcguaggucaucaugugggaugccccccucccccucugaguccuuuucuugauuccuccagguccgguugcugggugugguaucccaaggccagcccacccuggucaucauggaacuaaugacacgcggugaucucaaaaguuaucuccggucucugaggccagaaguggaggucaguuuuguuccucgcuguguuaucuugcuugguccacuuuuuucaggagcuggcuuguaggaaacgugucuuuaaguccauuugcuucucagccuugagugccuugagauaugcuuucuugucaguucccucuauauaggauuguccaaguguaggcagacugggaucuuuggaaggucugucucugcaucccacccauucaaccuccagcaucucugugcucuuguuucugcauccccgcuaccccugccuacaucuuacaccaaccccagcugcucuaccacgugucauggccaacccuucccacagcuucccacucaggccgggcuggccucccccacugacuuuccaguacacuugacugccuagcauacguuuacucucgagguccucggggugagccucuucuuuaccucagggucaugaccguggcugguaaccuuuucaguaaguacucaauaaaggucacucuucagguugucagagguuuuggccagagugacucgcagcccggucugugcacgagaccacuguuuccucaggagcccauuacacacacacacacacacacacacucacacacacucucacacucgcauacacacucacaaacacacucacacacacacacacacacacacacacacacacacguguacaugugagcaugcuauccuuaccuugauggcacacacugcucuccccuugccccgacacugcuucagacacuucucaaacccugaaccuacuccccaggcuaggcaauaagccaguauugugccugcgcuuuuaaaugauaaccauuccagcugcaugauucugcuuaaggcuagugagauuuucaaacugugaaccugaguagguccuguguaauuuuuugauuagucacuguggaguguccccuucuguuguguuagcccacagccagcuuuuuagcauaugugagucugacuucuuuuuuguuguuguuauuuuuguguuuguuuguuuguuguuuuuugagacagcauuuuguuuuguuuuuuuuucugugcagccccggcuguccuggaacucgcuucguagaccaggcuggccucgaacucucagagauucgcuugccucugucucccaagugcuggcauuaaagguaugcaccacaagcaccuggcuuaaguuuggcuucuaaguccucacuaagaguuaacugauggggguguugagaaauauugcuggaccaaaugccuuucauggggcugccucaggcucugaggcucucacuucggcccuggcuuugauaccuguggcuaacuaagcagcuugucucugcauucgcuguaaggggaacuuccucuucucgggcccuuucuggguuugcuccccuucucuguagaagcuuucguuuucuuuuccuccacaacguaaucaucuaccaagugauggaugguuccuucauuuuaguucugaguaccuguucacaaauguccucauguguguuucugaaguuucaggagagagccacaaggcgguguaugcauugauagcagagccacaaagcuaugccuguuucucccagcagcagcauccuaccccaguaauacccagucuacagaaggagacuggagagugguccuuuaaggcaccuccuaacaucagaaugugcuuaaugccuuugacacaugcccagaguaaacccguaacuugugcucucggggcuguuuuugccauugguuaccuccaguccucaguuaacagaugccucugggccuccgcuuccucauguagagagagaaagggcuauagagauggcucagcaguuaagagcacuggcugcucuuccaaagaacccuggguggauucccagcacccacguggcggcucauaacugucgguauucacuguucugcuggccuccaugggccuccgugggcagguagugcacaaacacacaugcaggcaaaacacccacaaacauaaaacaaaauuuuaauucaauguaaagagacagguuggauuacgaaagucucuuucggaaguaaaacuuaaucuuuaaauucaucagaucuaaauuuugucuaacucaugucagaauuuuuuaaaaaauaacuuacauauaucuuagcaucaauguauacuccacaguucaguguauauacccuagcuccaguauauauacccagcuucaguguauacaccccggcuucagcguauucuaccuccccccauugcuguuugcuuauuuacuuagauaaguguauggaugugugcucaccuuaagaggcucuaacaaaacuaaagauuucuucuuucucgagaugaagaaaagaaugacaacauauuaccaugaacugacaaaaugucagcccagcccuuuccugcacauaauuaaguccccauuguugguuguuuuucacauguuaagugacagcucuuuguugaacaguuacacaacauuacacacauacacugcaguaugugucaugagccuauaaguacaugucacggaacugcagagguccugcuuugccauguguauguaagacccuaacggugcuaaaggucagcgugacaaggaagcaccugugauggcacauccucugaggacauccccuagauuauaggaagagacccuggaucagagugaaaaugguuaaauagauaaaugagcucaacuugguccucacaugccaugucgucuggagaguacuccuggacgugcuagagggcuguugcuggccuccuagagucuggcaucugcugagaacuuagcaacccuggccaagagccagaaugcucuugaguguucaucguggucagagcacaaagggccuauauacuagcccaaauagugugaucuccaagccuggucaugcucuccugugacuugagauacauuaggaaaugagauggcuucauaguguuguaugagaagguuuucaguuagggaaacugaggcauaagggucaugguugguuuugcacaugggaguggggugacggagcuuugggaauuuuuuauguuuguauguguguaguguguguguguguguguguguguguguguguucaugcauaugcaugugcauaccuacuuagaccuugagggaguugguuuucaucuuuuaccauaccugucuugggacaugaacauaggcccccugucuugacagcagguaccuuucccacuaagccauucucaucagccucuuagacauaaaucuuaucuuauuuuguuuguuuguuuguuuguuuaugauuuuaccacuucuuagguuaauucuuuucaguuccuaaggcagcaucuugcccuccucuucagacaugauauugguccucauugcugcucaguguccuugguccccuccaaggugaacuccaccugaacugugguuauccucagugcccguagaaaacaguaauccaagaggaaagcauuagucuuccuaucuuuguaccuuagaagaagggaaugaagacgaauaaguccuggcagcuugcacgggaagcaaagcucgugguaauccacuuaggaagugugucuguuucacguggccuuuguacggguucucuguccuuccucuuacucacacuuggugauggcggaagccaaaggaacauggaaacuagcuggagcugagaaugcuuaaugccuaaacuugcugauucacuucaaaucauuuuuguccugcuccaaauagaaaagacuaggggggaggggguggucacaggcauaaggaccagaguucaggucgucagaagccagguaaaggcugggcugguguggcagcacaccugugauuccagccuuggaaggaugaguugggauccccagagcaaucuauguugaccagguuggguuugauagggacacccugccucaaccaguggguagaagguagcucccaacauaagcuucaggcccccacauccaugcacaugcaugcaugggagggggugggaaaagagauugcuggucccuagaagugcuaguccuucuuagcaaguccugacucccugcaggugaccugugguacucagacuaaguaaauaugcauuuacgacuccuaguguagaccuacaggagguuaggggggaaaggucuccguugcucauggcuuugucuuguuuugaaucugcagcagaauaaucuaguccucauuccuccgagcuuaagcaagaugauccagauggcuggagagauugcagauggcauggccuaccucaaugccaacaaguucguccacagagaccuugcugcuaggaacugcaugguagccgaagauuucacagucaaaauuggagguguguccuuugcuuuccagauuggagcacaggcuaaacugaacucacaggugcugaggggacuuugcagucauuagucugccacuggagagauuuucauuauguccgagaggagcagugccucgcccuugagugcaaagauguauguagucggugugacugucuauuccuggcuguaacccggagagcaccuuaacaugguaguccagauuggcgcccugcuccccaggucaaacguuacagaaauaaucggggcagcuugcuuccugaagugguuuuggcuugaggagaaugucaccauccaguccaccccucaaguuucucagcuuacaaagagcauugucccugaauaggcccaugggguuccuaagaggccaggugccccuauggugaaacccugcauaguguaacaggaaggguauaugguggucaugucaguccgcgggagaucacugcugacugcuuuucacucauaggacuggucggcucuaaguucucuccuccucuccugcugccaggaauugaaccgagggccugauguaugcugcugguuaagccacugaggugcauccuucagugguagcuccaagcacuuggccguucugucgugcauagcuuccugccaugaccuuagcugcucagccuaccuuguugcugccaacacauugugauccuaaaacacugauugcauuacaucucuggucauuggcuagaaauucuccccagccuuacagcuuguauauuggcuuuguuuuuuugucuuuuacuucaaaaaaaaaaaaaaaaaaaaguaguaacaagguugcucagaaaaccauccugcauauacuuuaccuuccuacugcgauaggccagcaggucagaaacauaacaaguguccauccugagaacaagcagagggacagacgauguagcagaagcgaucagccacuaaccuuuggccgccucuugagcuuguguccuggagauguucugcuugccucaacccuagaagugguuuuugcaugagccauuccggccucuuaguaagcgaugggugucaucucuagagagguauccaaagucgggcucucuucuuugcugauugcaggaguuagggguguuggcaugcagcuguguuacagaacagaugucagucauuggaguuacugaagauacccccagccugucucuggguuuguacacucauauuuggagcccugggagccuagcuuggugggcagcccuuaagaggauaccccgccccagaguuucuagauaagaggcgcauccucuuaaccagccuuugugguccuuccugccucccaucccucccuuauguguggggaucuagauuuuaguccucagaggaaacugugcuccugaguggccugaggcaggugccuucccucccugugccaucuuuccccaccuguggagugagaguggauugggacagagcuggaggaggaggcgggcugggacagcaagccugugccccuguccucaucuuacccugcugugcacccuucucagcacagccaggaacuccgagaggcugcuuuggucccauuuugcauuacaguuggaaaaaugcuuuugugugugcgugugcuuuuugccauuuuaaauccaaaucaguaaggauuauauuuucugcuuaaccauguggcgcauuuaugaggauauuuucuauuauaauuaugauuuuucuuuuuagaauuaaauugugugugcccguuugggaagaggggguuguucuauuuuucuuuugcauuuagggagagagauuguuuucuagaauuccccuuuuaugcaagucaaagcagauccucucauuugcaugucucuggauuaauucagagaugagauuuaagcacuuccuuuuuccuccucgggcgaguucugcauuccucagugucccccagugcccccaucucagggauuacacacccuaaaucaguucaagagaggcagccaguagcucagacagcggugcaagucaauuguguuggguuaacauccaugcagagcaaacccuacauggguuugcucugccuuuuuuguaccucaccucuuuguggcaccacuuagaggugcgaggggacauuuuaaagguugagcagcucuucccuccagggaaggagaaugcaagaguuuaugugagggaaagguggugcgguugaguggaaaaucaaaaauggauaaagacacaguaaugugagauuauaaaaaagcaagccugccauucaccaugaugaaacucagaaaauggaaaacauuuucaaaacugagugagaguauuguguugggaaaggguguuggguaguagcuccaggagccuggugaagaacaucucagcuguuugcuguccuuuuaucuuccugaguucuuacuucguacauuguccucuguggaguggcaaaaggccuuuuccucagcaguagagacacacuaccaaguaaauggggucuucauccucccguguauuggaccaaacuuuaaaacuauauccucacccugugcggcguauauuuucuugaaaaaucaugguacucaaugauuuugcaaacugccucucgcuuuaaauguuauaagggaguuaauuucuuaaaggagccugaugaagaccagagaugucuuguauucuccugugaaguggcugugaugcuagagcccucucagaguggagcaagaacaugucucaccuugaauauggggggaaggacagggcucugccccaagaccugguccagccgaguaacugugcaucuucccuccagauuucgguaugacacgagacaucuacgagacggacuacuaccggaaaggcgggaagggguugcugccugugcgcuggaugucucccgagucccucaaggauggugucuucacuacucauucugaugucugguaugagaguuucccuccauggccagcuuggaccuucucacucguggcucauucuccuccuuguuuuguucacugugaccaacugccagccuugaguucagcucucagugccguuuagcccuuugucuuuuagauauuccuguguggaguccauuaaagcaaaaaagguaucugugggaagccaaggaguagguagaaccaacauuuccuuccauuuuuagcaaauauugauuauauuuccaaagacuggggaaaugccuucgccucugccuguucccccgucucucuuccccacucucagugaguugguacuggguauguaugugcuccugccgcagcucacgaaaccuucagauugaaggcagugcuuuauuuaaacccaaaacuugagucuuggugguugugguuuucuguuggucucaucuguucacacacacacacacacacacacacacacacacacacacacacacacacacacgauguccauuauuccugacccaaagcaucuuccuuaauaauaagugucuugcgguaguagcacacugaccagagggugcaaagacuucucuguaguaauguuuacugcaguuccuuggaaacaccguguggaggucaucggguuccaaaauacaacuggaguucuuggcaggcaggagcccuggcacgucgucccccuccucgaaugucagcaagugucuuggcugucuccucgggagaucccguugcuguugugucacagaagaagcggugguugguuuauucaaagggcggaugaccacacagagaaacuaucucaguagugacugacaucaguucuuuagccucgugaaccuuucccggucaagagccuuggaucuuguuuggaagacaggugcaaauuggaaauagccuuugaauaugacccagcgcggccugguuguuucccgacucuaggaugaggucugcucugcaauuagccucuccgagguuacaucuucucugucgaaucaaagaacucuguuccauguguagaugaggucgcaggagagggcacaccuagggccacacuuccaucuguuuguucuaagcuucauuuuucuggaagcuuggagaucaccuuacaggauagggaaagagugagcacagacucauucucccccgacucuggguaacaacugcaugccacagccagaggcgcacagggugcuuccugcagguuuccuccacuuggauuacguagccauuacaaaccaauaagaaaaugcgugaagagaaaaggccaagugcugggguguuugagcacacagcuggggacaucaaggacacuagaacguauaaacggaugcucagcucugccugaaccucugcuugcuagaggaauugcagucauuuuagaaugaauucacagucagaaguagguaaaaauccaaagaaaaguuggaaggauuuuguuugacuugguaggagaccuuaggaacauggugaggggagguguccucaggucaagccacacccugaccaucugcauuuaucacagcuguuauuugagcuucuggggagaugucccagggacuguccccucccucacaagggcaggaaggccagcccuuacacgucuucguucuuucugauuuauacucucuaucuuccuguccguccuaugagcagacuggcugcugagauggggugggauggaaugggaaguuggccugcagggaguccaggaggagaacagggugccagcaagaguuacacuggagcugacaugcugagucuguagagucaaguaaccagcaaucuagacauggcagucaagagcugggggccaggauugugacugaaugccugaaagccuguggugcaccagggaaagcaugaaagacaaggggagucggcuuggaagggaaccuggucaagaccgguugauaaaaagagaaaaccacauacaucacugcuugucucaggccggauucagacaugagggugagcacugcagccucuaaagaaugccuccgaguguccacaaaggcucugcaaggcagaacccaggccugaaacacacaggaaaccugcuucucuagggccaggucuuugaaaaccguaacugcacugucugucuuagugacugccgguucccaaggaacuugggucugauugcugagguucuguuccugucugacauugcuuagcaucaguugggacaaaacccuuuuguuccuagaaggaaacugaagcugcgaaccaaaaguuaagaugcagucagaggcuguugcuccagcuuaggccaggauccucagagugcuaaguggaaaauggccgccucaggcucuucuguggggcucagcccugcuaggguuccauccgaagccuuguguuggcuugccaugggcagccuucuucauucuagccauacagccugaccauaagagcagacaggccaggaagaauuuugugaaagcaaggguucucccugagaagguguguucacacugagcgacagugugaccauugucugucugaagugucugcaugcauggaucuccuuuaguuccaucuucugggcugacaggccauaccucacgcaguagaauccucgcugcuucgccugaugaguucauaccucagccagccucuagaccaagggacucuuuguuauugcgacacacccccuggccaguguauccuaccccaguucccuuccugacacagccaccucugcagccauggcuccugaguucugcaggggacgaguuuucaucuuccuugacccaagucaagauccuacagaacuuugagacauuccaggcccagcucccuacccuacaaccagcaggucagaauugcuuuggagagcccaagauacccauuguuuuaagaacccugaucagauucuucuugcggaggcguggagaaccauuagcaucaguauuucuaagcuggcaugaaagaaaucccugcaggagauaguugagaugcuuagcugucucaggucaguggccaggcugggaccugguccucugcauuccuugcugaacuagagcuaauuuggcuuauguccaaguaauggcugggaccagacacugaauguguccgcuguagaucgggcucuuaaaacugugagagauguuagaagccccuaacauuaauuaccucagcccuggguugcaguagcccuauaggaagccuuagcagugacaaaggggaacagaugucccacacguagcaagcuggcugguuugauguccacaaagugcagucgucacauugaggacacuuuuuuucaggacccagagucuaagaaaugcuggcaaggaggggacauggcccuucccaucccuuucugagcuguuccuguucuguuccaccuguagguccuucggggucguccucugggagaucgccacgcuggcugagcagcccuaccagggcuuguccaacgagcaaguucuucguuucgucauggaggguggccuucuggacaagccggacaacugcccugauaugcuguauguauuuccagagccacccacuccguuguguguggguacaggagaggauuagaaaggcucuauccugcugcugcugagcuuguuggaucugugacuuugugcugcuccuuaaucucauccugugcccccuugguccccccagugcuaauuggcacuuugcaccauggcgugcgucucagccaccacuacccccccccccccaucucccaucucugaaauacaugagcaauccuggcucaucuuuuucaugcaaaauuuaauuuuuaagacaaaaaugcaaguuaguuacuacugcugagccagauuugaaagcucuccccaagccccuggaaggucuauacagcaugcucacacagagcucuguggucaggagucacucucuugcacggguagacuaaagcucagagagccccagcacaaggucacagaccaucugcugucuucuuaaucccuucgagcugcauggaccuacagcacgguugagcucaucccucuuuggacaugcuuguaggcacacccuaggggggguuggugagaugguugccucgcuccacuucuguuaaaaauaacauccugcaucgauugguugugagaauugucacucgauggcaguacacacguggugucacguccaccuccgugcucagccagugugacucgagaaacucccugagauaaacagcuuacaaggagaagcauuucacauuggcucccagugugggagcggcagugggguccauuggauuuguggcgagguaacuguuacgguagaaaaggugugucagagcgcacagucucacuuuguggcuugaaagugaaagggagccauuagagaagccguucucuaccugugagucgugaccccuugccccuucacaggaguuaccugagaccguuagaaagcacagauguuuccauuuugccucauaacaguagcagauuacaauuauaaaguaguguuauaguugggggucacaacgacaugaggaacugugucaaggggacacagcauuaggaagguugagaaccccugcauuaaagggguucacaaucuuccugcuguaguccuaaaucuugaagauaacuuucuaaugaccuggcagccuccuaggcuccaccccucagaaguuaccugguguugccaaaauuggggaagaaucuuuccacaugugggccuuuuauuuguacucucuugaguagaggucuuucuuugucaucugauguugguggcucagugggucuggagaaugacacuucuuuuuuuuuuuuuuaaaagauuuauuuauuuuauguauaugaguacacuguagcuguacugaugguugugagccuuaaugugguugcugggaacaaagguugcccacuccggucggccccacucacucuggccuaaagauuuauucauuauuaaaucuaaguacacuguagcugucuucagacagcaccagaagagggcgucagaucucauuaaggaugguugugagccaccaugugguugccgggauuugaacucaggaccuucagaagagcagucagugcucuuacccgcugagccaucucuccagccccgagaauggcacuucuuggagugagguuucaaggaagacaugaagguauuccgauuggcucaucgaguacagguugagagcaguggacuugcauuugaugugcacacguuaagguggggcucggcuguugcucugcaucucgggguuaagcaucaaagcagguucccacugauaugucaggacccauacaguuucccagaaacacuucaaaacagguucagcuccacuagugaaagaaucccagggggguugucaagauuucuucacuucuacacaaaagacucugccuaccccuggccuucucuuccccagcgcagcgcucacucucguggcgccuuggauggugaggcaauguacagauggagagguugggcgugcagugcagguggugggcagagcacagagaggugcuagugacuguacucugaaucuugagaugucaaggugugggcuagcaucgucccccgugaggcuccaacaguugaaaaugucaucucacaggcuuucuaaugaaaccuaggaggagcucgaugaggugacacuagcuagcucagggucuccagaagauagcugcuggucagaggcagggcuucccgcagaugaagauacuccgguacguggggugauuguaaggagaucggauuuacuacagggcgguaggaacagugaugguucuguguagugggagaggccguggcuucucuguggaccacuccauagacugagaggauuucucuaauacacuggagaggauugguggugcuggggaccgcacgcucacucuuccuuccagccccucugcucugccacuaugauucaggaaucaacaaggauggagucaguguagcccagguauuuaggauaaucuuccugccucaaacuccccuagugcuuggauugcagccaguguuacugcuggugcccaacuaaaacuuuauauuggaauuugaauuccucucguuuucuucuuauaaaauacuccuauuuggggguggggcgugggggacuuguuaauuuguuuguuuuugccccagcuguuggcaaguguaaaaaaaaaaaacccucuugcuugggagggccuuacaaaacugaauagacagcaggccauauugagccacugacugguccguggccugcugugcccugcagcaucuucacggagaacacugccacuguggccuuucuaaacugaccuccgaaggcguacaggaugcagggggccugccuagagaagcucuggguucugagugcuguuauagcuuuacuuugaccucaguggugcagggcaguccuacucguccauugcgagaauagucaguaugugggcaaaggugaaaggauggaguaggagcauggcugccucugagucuguguaagggugugccccaccagccuugguuaggauaccaggaucagcacugucucacgagcugagaaaccguucaaaagagcaggugugaguuuuguuccugugguuugggccuggucacaggagagguauuguugguuuuuuucuuuucuuuuaugcuggagcaaacauuugucugagaaacucauggaacuccugaaguugauccauccccagcugccuggauuuuuuuuuuuuuuuuugguaugaauuuaauaugcuugggaaggagccaccugcuaugggaaaggcaguggacuuccuguucccagcauagagaggaggaagcuuacacacggaggccgcucuuggaugcgaaaugauugauucaggaggccuuuuugcuuugccauucagaacccccuuggcagaucggucuccuuucuaagaaaagaacagagugaagggaagggagccgggcugcuccaguagggaguguggugcccugauuuggcugagacgcugaugagaggaagauguguucugugaaaggauuuuuuuuuuuuuuuuuuggcacaguaagcaaacacucuugggaguagucugaagccuguugggucucacacguagaggaaggacuuccauggugugguucugaggcaggaacagcccuuucucuggccaugcuuuggucucgucgucccuacacaugaaccagucugcuucaggaguagcuaaguauccagccuuguguauuacaaaguguucuagcuuuagaggaaaggcugccaccaaacaccaggguauccaggucugacugucagugcaauagcucaguuugaauugaucuagcaaauucugugaggcugggucaggggagccuaucauucccaucuuuaccccuggguuucagggcuuuggacacagauuugucagugaacccugcugaggucaggggccagucccagaguucacggaaccuggagauccugaaacagguuccagcccucgugcugcagaaugggacgacgauguaagcucagccacagaauugauccauuugauccauuaacaucuccagagcucacaugccaagucuucgggaugcgggauucaggaaggaacuugaacguuuuacuagccgagcgucaccagcucagaugcagcugagacauacucaguccaaucugacuacuucuguacuuuuccucuccacccccaggaggcugggaaucccagucugguuuugucgagauaaauugaauagagucaucacaggcaggugacagugucugcuggacggucccuggcaucgacugugugccagcaacugggcuauauagcauccccgucuagguccuggcccuaaaacaaccuuaguugcuugagaugcuagaggaggacccacucagucccguaggcccuucugaaagucugaucccugcuaagagucacuacuaccugguacaguacuaacaggcggcagcagggguacuguauacaugagguccugggcauauuucaguuugccagugccucacauagauggcagccuguccagcugaagacacggggugugcuugggggcucagaagccaagugaggaaugggcauagcggugggcguacaccccaggauagcacucacuucuagagggauaggugugcaccuucacagagggacauauucuguaaaucgcggcuccagcucaucagagcuguccagugguuuuaaagugugcuuuuuagagggagcauuuuaucagcuuauuaaucccagagucuacuggagaguuuucuuguggaaagaguauuuaaaaaaaacaaaacaaaaaaaaaacaaggucuuaaaucgcacagagcaaaaaagacuuccuuuuaugggcagcccuggaagggcugacucugggaugauuuaaaagaggcaucacauggcuuguuuuuacugaugucaccucaucccuacccugcccguggcaccuccucagccccaccccccaccccuggccacggggcuuggggccagacacaucucauguucuugcccccgguugcacuuuucuauucagggcuaggccugucagccagagaggaaauugcagccuggccacggagcuaagcuccuugugucugcuucccauuccgauuaauccuucgggaaaugauggggaccggggagaacaagcuucugcagcagcuaaccagagcaagccggcucaggagaucugacugucuguagacagucgggagagcgccgucugcuagcaagaccaugguuacuuacaguaaagcugcauugucugacagccucacgccguuccagcucacucccugugugacuucagacaaaugaucaaaugcugugguuggugcuuuucccuuaugcauacaaugaggauguguuguaaucauuggaguaaagagacaucucuggcucucggggacugacgugacucccgggccuagagcuuuuaguaccuaccugcaaccugucaugugccacuaggaccagucacuuagagccagugagaauaccuaguuagccuggucuuugguccaguuuguuuuccuccgucgagacauuggccacuuaauugggauuuuucuuuaccuccagaggaguaggcaguaaauauuguaagguuccuagcuaaacagccgcugucucaacuacucagccuacaaaggagcuuagaaacagccacaggugcuguguaaccagcucugcucugguacaauuccgcuaacaacaggcuccaagcugcaccuggcuccgcuguaauugguuggcuucacccugggccuccagagugcuuaauucuuggagguggaucuccaaugcaccuuuuuucaguuuuaagauaacuaccuuccaccuggccugacuugauccuacagaguccaaggaagcuggccagaugggcaagaguggcuuucucugcacaggcaacuucaugccuaccaauagguugcuuucacacgccuuuaccccugugggauuauuugcuuuguaaagaaguguccugguggcccagugaucagccugguagaauguuagaagccuguucagggugcuuugagauuccuauauguucgaacuuccauuuguggguuuuaguguaaagcgucuguugagccaggaguuuuuauaaaacacaguuuccuggaggagcauagguggagagugcuuuggucucacacgccugugauugagagcugcuagguaccccuuucccucagaaucaugaccacccuguccuuguuuucugucgggccugugugucuguccauccgucagagcccaggugugguucacugcauggccuggguugcagaacuaugacuugacgagggcaucaagggaaugaacaaagagugugcacuuggguauagagaaacggggacugcguggacugggcucuggaagcucaguauguuuagcguauauauuugaacagagaggcagauuacugcaugcagauaaacaaggaagcaggauuauuauauacagcugaacauggaggcagguuuagccaucucugcagggaagccgucuugaggcuguaaacuuccaggggaaggacgugacaguggacauauucugcacacacugucagcacuugcaacucggaccucaggggaaggcuuuaccaucucucuaagcaagcaucacugggguagacuuugccacucccaugggacuggggcauugggguccuugacauggccuugcacgugucagcaauacacaccuucacuugcuuagggucuccuccacugucuacucccaggccuuugcuggucaggacgguggcugcaugagcagccuuucucuucuguccugugugccagcuggcccauguaacucucgaggacgaggaagcuuugcaaagguuugugaccuugugggagugauggagguacgucaugggcuuuauacuguuuuuaccuuggccuuguuuguagaagaaaaugaugcuuaggacuucccuugguucguuggcauccgacuugaaguuucuauuagaacucugcuccugggcauccuacaucuucaagacagggaucuuccuucaugggacauccucagugagcaggugcuggcgugagauagcaagcuugggauaugugcuccgucugucuagcaccccugccgccuccucccucaggcccacugccaggggcgcccuggugccaggaagaaacuuagaaauagcccuggugugagauacagagaauggugccugucaggaaagcugugauucucauuagugagagagagagguuuccucuucugguuaauguguggccagaagaggugcuuagacaggaaguggguuuuaucucuuagcagugcuaucauuaauacaaccguccaugguggaaucggugaaccaagacuugaagugagucugggcuuggcacuguggcugggccuggguucugggcaagauacauggcaggaugccagaggcauccagaugggaagcagagagugcagaggugguacaguucuucugggucucucuggcagcucauuccuuucuuccccaucacucccuuagguuugaacuuaugcgcaugugcuggcaguauaaccccaagaugcggcccuccuuccuggagaucaucggcagcaucaaggaugagauggagcccagcuuccaggaggucuccuucuacuacagcgaggagaacaagccucccgagccagaggagcuggagauggagccugagaacauggagagcgucccacuggacccuucggccuccucagccucccugccucugccugaaagacacucaggacacaaggcugagaauggcccgggcccuggcgugcucguucuccgcgccaguuuugaugagagacagccuuacgcucacaugaacgggggacgcgccaacgagagggccuugccucugccccaguccucgaccugcugauccucggacacaccgaagcacgcgccaacaguaacgugugugcgcccacucggugggcgggggggcggggaggggagagcagguuguaacaaucuauucacaagccuccuguaccucaguggaucuucagaccugccauugcugcccacgggagacggcuucucugcaguaaacacauuugggaccuuccuuuuuucaauaugcaagcagcuuuuuauuuccuuuacccgaacccuuaacugacaugggccucugcaaaccuuaaugacaacacuuaauagcaacaggacacucgagaauugagucucuucguucucugccuuuuucucuccucugccuucccucucugcccucuccccuuccacuuccacgcucuccuuucucucuuuucugcuuuacaguggaaaaauguuugugaacgcccaucugggaagccuucuuuuuuaaaaaaaaaaaaaaaaucagauugacuuaauggcugccccuggggcuccucaucaccccgcauacaccugccugacaccguaggucuuuuaaaaaaaagaaaaggaaagaaaaagaaaaaaaauucacacacugagauggaauuuuuuuuaaccuuuuuuagggucaccccaaaauuuaaaagggccauuguucauccguggcuaucauuuuucacgcugccauuuuugccaaaauccuguuuucgguuugguuuuucucacacgcauauacucccugcgcugauuucccuuuguccagaggcgugggaugaaccauggugucugguugaugauaacauuugagagacacgugcugaggccccccacugugcccggcucucccagcccacaucuccugggucucguugcaugguuaccguuugggagaacuggacaagauggaacucgcccuccuugaagaaggggaaagcagaacugguucuccaccccucccccacccacagcaccccaagaauucuggaggaaguggccaugggcaagcuugaaggucagguugugggucaaggugguccucacaccagccucgucccccuccccgaccucccuccugccccuccccugagggccacacacucgaaaggguuccggggacucggccuggcuguugguuauggauguucgaggaagggauucagagccacagcagccuggagccgcccgcccaggcaguggauccaagcagugugagcuuucacauggucuguuacuaggacuucuucaugggucucucaguucuauguuagaccgugaaacauuugcauacacaucgucuuuaaugucaguuuuauaacuuuuuuacaguucagauauucaucuauacaucuguacaggaaaagaaaagcugcuauuuuuuuuuuguucuuuaucuuuguggauuuaaucuaugaaacuuucaggucuaccccuucuuccuuucugcucacuccaagaaacuuccucugcuuaucacuagagugugguuuuucuuccucuucuccggcaacugaugcuucuaggacauaacuugccgugaacuguuugaugccuuuuuuauaaauacaucucccuuccccugcucccugcagccccauucauuacccucuaacccauaggcucugugagcacagucacaggugagggaguggggagggugggaguccagagcccacagacuccugggcccuacucucuccuuuccuugcuuccccgcacacagcaucugcuccagggcaaggcaugccacaaacucaggucagaaacaaaaagguuaaaaaucccacacauccugguuuaguguuucuagucccuguuguugaaagucacacuuugcuuucucuccuugcuuugguucacacacacacacacacacacacacacacacacacacacacaccccaauuugggaauacaauagcaguuuuaacugcagacaauagucauuggauuauuauuuaaaugaauauuugaucuuucacacacacacacacacacacaauagcugcugaguccccaggaugcagcagagcugguccaguggcccaucugccaccuccuucacaagcaggcccaccugucuuuagaaccagcuugucugaagggguggccucccugggagcaagauguaagacaccaacuccccauggccaggagcagcaacuuuagugggugugcuauaaagcccacucccgggccggaaaucccaaaguggaguagagcugacccuacaguggcccuagagccccuugcuguuccuccuuaaccagaaucccggagcucugggcuuggaggccccucccccuggagugggguugggggagggguccugucuuguuucgauuuagcacuucuuaccagagcagugacagcgcgagagaugcuucuggguggaaauauuuaaauuaggaguaggaaaacuguuggaugaugaugguugcaguugugacuggagauuagaugcaggaaggaaagcuggaguugucuggcuugucuguagguucaggcuuguggcucuuccuagccucugcccuuaaagggaaaaggaggggggaagcuuauuaagaagguauuucauguaggaguuuuaauuuauuuugugauaccuguuuuaaucacuguagaaaagccccuguuauggauuuaaaugcugaggaaaggguacauguaucucuguguauguguguauuagaugggacaguuuugggggguuuuuuugggggggcuuguuuuucaaacauuuaucuaccucacucuuguuuuucaugugugugugugcauauauauauaucacauauauauauauauauauaauacaucucacacuucucaguaccugacaguaggccaaugauccugguaaccucagccacuccgcaggccacauacccaggugaagcagagaggggccaggcuggauucugggguuaaagcaacgcuaacucaaaugagcagccucuuccugcucugucuccaaaagcccacuuuuccuagggcaacucuggucuuucuccucaccugguccccuacuuuucaacccagcagucaccaugagcacagcacgccaguggaggggggcuccccggcccauccucagcuggcugacuuuggaacagaacuuucucuacagauugaaugacugacaaauucuaucccuaagagagcagguacucccagguuuugagggcaggaggcacccacacguagguugucuugagagucccaaugugugcacaugucagggugcccugucagcccccucagcugcuccucugagaccugcaccgaggcaggggcaugccaccauugcucuccuggcauugguuccucuuggagguacagcggucagggagcucccccuucugcuucugacagaaggccaguauaaaaaagggggcaagacgaagccugugcccccugcaggcugcuguccuucccucuucuucccucccuuccccccccccccccgcaacccccagggcuaaacaaggacugaccaaaucuugaggcuggaaggccagugguuggcgccuagccuuccccgugcucugccucuguccacccauccgucugcugcucacagguggacagugcaauccucaacuccagcagcugcucuuacaggcccuggggacuucagcuggggaccgcgguggcuaaucuuuucccccaguauggagaaacugccuaacaguucgguuaagcucaggagcccuucgccuccugcuggaaugcugcccuucucuggguuccuagaugcucacagggucacugggagauacuguuugaucaggguuuucuucuacacuguaggugacacucugggauaguggccuauccucucgcacauaccugccgguuuuccacaacuggauuucuacaguucauucaauugauuuuaaggguuuuuuuuuuuccuuauuauuauuauuuuugaaacuguccgaguuguugguguuuuguuuuugcguggguguuauuuuuuuuuuuccuuuaaguagagagacggcaccaacagcguaguggccgucauaaacuaaugcuccagaaacacuucaauaaaaagaaaagguuggcuuguacgagggugcagucguucugcuggacugacgcgccccgacuauugcaaggcaucauauccacaguucuagccugaucucaugcugauguuccccgccucuuccugauuuuucucuuuacaagcuucaaguacuccuaccaagcugagucguggccuuuuucacucgagcccacccccacccaacccccccuucugauaggagcucacacugcuugaagucacaugaaccacugaggcacagcaugcaggugacgugaacauccaggugugcccccacacagcccuuccugaggcguggagauagagcugaaccugagcuggguggggcccacgcuucgccaucuccuuucaggaauguccuaacauuggauucagagaugggaugaggcucccuccuugagauauaaaagacuguucaagguugcucuuuuuccuaccugccuguuucuuaugacucgggacuguucaacgguaggaaaagcagcuucauaaacuagaaaagcgaucacggugagacgagcagauggcggagugguauacaggaguuuuuagggugggcugacagauggaugagcucuguaugaugccaaguccuaagccagccugagcucccggagccucggccuuagcagcccaccucuuuuggcagugccugugccugagguaagcaagcagugguggcaaggucacacugagcucaugugggugaggagucuaggaugcuuacccaaggcccucuguugucaucguuggguccucugagaguggccacagagugcugaaagcaucuccuuuccuaaacacuggcauccaggaggagacaggaccacuccaucaaaaugcuuuggcccauuuuagcaguaaugaauuuacgguuugggauuuuuuuuuucccuuugguuuuuguuuuuaauguuacuuuuauguuugucugaugucuuuucauuuccugggcuaagcagcugcauugggagaccuggaccagagagauccaccccuuaagaaccagugaugauggucaaacuuuuaacaguccacuuugaacuagguggugguacaaaugagaacuucaagacaggaugucuguguaaaauugaaccucucuugccagagaugcugaagauacagaccuuggacaggccaggggucuuugcuuugggcuuccagcuuggaugaccaguuggcgauuuagagaaacgaacauuccuugaugggaugacagagugacggugcaguaggcacccuugguaaccggcaucgugacaugacgggaauugcugacagaggguuaaagggccuggaagaagcauggaccauauuuggacuugauggugucugaaggugucagagcauguggaggcuggggagucaacugugggcauuugguuucagauaagacacuuggcauccugcucuggaaacuucuccuuagagcuaagucacgugcggaaggacucagacuccaucacacucaucagaugaguugucggucuggggcaugacguuagggauugauuugauuuugguuucugugagaacuucauaaucacugauuuguguguccacauuugugucugcaucuuuccaguaaaccauucuuuaaauuacucauuauccuuucaauagggcuucuaaguccaguagauuacggguagucguugacgaagcucugguuuacaagaacuaauucaauguuucauugcauuuuuguaagaacauagaauaauuuuauaaaauguuuguaguuuauaauugccgaaaauaauuuaaaaacacuuuuuuuuucucucugugugugcaaaaauauguguuuguggucuuuuuucccccucuuuguuuccuuuuucuuuuuugacacuuguuuacuagcuagcuuuacaauaugccaaaaauaaaaaauaaaaacuuaaaaaaauuaauuaaaaagaaauucuccccaggaccaauugugguucacccucuuucccacaugcuuucugcucuaguuuguaaaaaaauaaauaauaaauaaauaaaacaaaaaaaaauaaaacagauaaaaauaaaaacaaaacaaaaggaaugccagugguuuaaaaaguacuucuguauucuucaguaucuugaucuuggaacccuuugcuggggaaaggaauuaucugggacucacuguucccuguggaguguagcagcccaaacagauggaaagaacugcuggccauggaaauagcaguguguggccacccagcaaagagauggcacuccauggugacaucuggcugguauggcugguccuagcucugcaacacuauggagaugggaggguuucaggacacuggaauggcuucacagugaucacaugacucugaugugcagcccgugggcacaugugccucagauccuaacgaaugcugugccuaccuguaucuaauggcgaacgccgaagguccauuguuuucuaauacagaacaaacugguaacaaaaaccacaauguguguccccucgcccccuuuuuucaaauuaagauccauguccuuuggcuccccgugcauuauuggccaugucucucugguuccacaagauaccguuguugaaaacacauggaacuuucuaacacugcaggaaaaaggucugggaaccauuuguggguuugguuuggucuuucaguuucuuguggguguugggcagugugcagacacauguacagguggaguaggugccugccuggugacaaccccugucugcuuccuaugccagugagguugaaguaagaguuuugccagaguucaucuaccucugggauuuaaaaaaacaaaacaaaagucaaaaggcucgauggagcggacacaucgccaauaaugcauuucugaguuuucuuguuaaauuuuuucuuaaaaaaagaaaaaaaaagucuaaaaaagauaauaauauggccaauuuguuacauaaaauaacuuucuguguauaaauuauuccuaaaaaaaaaaacccucuguuuauauauaaaagaaaaucaguagaugaaaaaaaauucaauguuuuuguauauucuguuguaagaauuuauuccuguuacugcgacauacucgggauucuuuacauuaugaaaaaagaaacuuugucuauuuugaauggcuaaagcuaaggccacuugagucuauuacucugcuuuuuucuaguaguuaaaguaccacauggauuaaguuaaauaaaagaauucuguaugc

SEQ ID NO: 12392 - RNA, 281412 nt, Mus musculus
gcauacagaauucuuuuauuuaacuuaauccaugugguacuuuaacuacuagaaaaaagcagaguaauagacucaaguggccuuagcuuuagccauucaaaauagacaaaguuucuuuuuucauaauguaaagaaucccgaguaugucgcaguaacaggaauaaauucuuacaacagaauauacaaaaacauugaauuuuuuuucaucuacugauuuucuuuuauauauaaacagaggguuuuuuuuuuuaggaauaauuuauacacagaaaguuauuuuauguaacaaauuggccauauuauuaucuuuuuuagacuuuuuuuuucuuuuuuuaagaaaaaauuuaacaagaaaacucagaaaugcauuauuggcgauguguccgcuccaucgagccuuuugacuuuuguuuuguuuuuuuaaaucccagagguagaugaacucuggcaaaacucuuacuucaaccucacuggcauaggaagcagacagggguugucaccaggcaggcaccuacuccaccuguacaugugucugcacacugcccaacacccacaagaaacugaaagaccaaaccaaacccacaaaugguucccagaccuuuuuccugcaguguuagaaaguuccauguguuuucaacaacgguaucuuguggaaccagagagacauggccaauaaugcacggggagccaaaggacauggaucuuaauuugaaaaaagggggcgaggggacacacauugugguuuuuguuaccaguuuguucuguauuagaaaacaauggaccuucggcguucgccauuagauacagguaggcacagcauucguuaggaucugaggcacaugugcccacgggcugcacaucagagucaugugaucacugugaagccauuccaguguccugaaacccucccaucuccauaguguugcagagcuaggaccagccauaccagccagaugucaccauggagugccaucucuuugcuggguggccacacacugcuauuuccauggccagcaguucuuuccaucuguuugggcugcuacacuccacagggaacagugagucccagauaauuccuuuccccagcaaaggguuccaagaucaagauacugaagaauacagaaguacuuuuuaaaccacuggcauuccuuuuguuuuguuuuuauuuuuaucuguuuuauuuuuuuuuguuuuauuuauuuauuauuuauuuuuuuacaaacuagagcagaaagcaugugggaaagagggugaaccacaauugguccuggggagaauuucuuuuuaauuaauuuuuuuaaguuuuuauuuuuuauuuuuggcauauuguaaagcuagcuaguaaacaagugucaaaaaagaaaaaggaaacaaagagggggaaaaaagaccacaaacacauauuuuugcacacacagagagaaaaaaaaaguguuuuuaaauuauuuucggcaauuauaaacuacaaacauuuuauaaaauuauucuauguucuuacaaaaaugcaaugaaacauugaauuaguucuuguaaaccagagcuucgucaacgacuacccguaaucuacuggacuuagaagcccuauugaaaggauaaugaguaauuuaaagaaugguuuacuggaaagaugcagacacaaauguggacacacaaaucagugauuaugaaguucucacagaaaccaaaaucaaaucaaucccuaacgucaugccccagaccgacaacucaucugaugagugugauggagucugaguccuuccgcacgugacuuagcucuaaggagaaguuuccagagcaggaugccaagugucuuaucugaaaccaaaugcccacaguugacuccccagccuccacaugcucugacaccuucagacaccaucaaguccaaauaugguccaugcuucuuccaggcccuuuaacccucugucagcaauucccgucaugucacgaugccgguuaccaagggugccuacugcaccgucacucugucaucccaucaaggaauguucguuucucuaaaucgccaacuggucauccaagcuggaagcccaaagcaaagaccccuggccuguccaaggucuguaucuucagcaucucuggcaagagagguucaauuuuacacagacauccugucuugaaguucucauuuguaccaccaccuaguucaaaguggacuguuaaaaguuugaccaucaucacugguucuuaagggguggaucucucugguccaggucucccaaugcagcugcuuagcccaggaaaugaaaagacaucagacaaacauaaaaguaacauuaaaaacaaaaaccaaagggaaaaaaaaaaucccaaaccguaaauucauuacugcuaaaaugggccaaagcauuuugauggagugguccugucuccuccuggaugccaguguuuaggaaaggagaugcuuucagcacucuguggccacucucagaggacccaacgaugacaacagagggccuuggguaagcauccuagacuccucacccacaugagcucagugugaccuugccaccacugcuugcuuaccucaggcacaggcacugccaaaagaggugggcugcuaaggccgaggcuccgggagcucaggcuggcuuaggacuuggcaucauacagagcucauccaucugucagcccacccuaaaaacuccuguauaccacuccgccaucugcucgucucaccgugaucgcuuuucuaguuuaugaagcugcuuuuccuaccguugaacagucccgagucauaagaaacaggcagguaggaaaaagagcaaccuugaacagucuuuuauaucucaaggagggagccucaucccaucucugaauccaauguuaggacauuccugaaaggagauggcgaagcgugggccccacccagcucagguucagcucuaucuccacgccucaggaagggcugugugggggcacaccuggauguucacgucaccugcaugcugugccucagugguucaugugacuucaagcagugugagcuccuaucagaaggggggguugggugggggugggcucgagugaaaaaggccacgacucagcuugguaggaguacuugaagcuuguaaagagaaaaaucaggaagaggcggggaacaucagcaugagaucaggcuagaacuguggauaugaugccuugcaauagucggggcgcgucaguccagcagaacgacugcacccucguacaagccaaccuuuucuuuuuauugaaguguuucuggagcauuaguuuaugacggccacuacgcuguuggugccgucucucuacuuaaaggaaaaaaaaaaauaacacccacgcaaaaacaaaacaccaacaacucggacaguuucaaaaauaauaauaauaaggaaaaaaaaaaacccuuaaaaucaauugaaugaacuguagaaauccaguuguggaaaaccggcagguaugugcgagaggauaggccacuaucccagagugucaccuacaguguagaagaaaacccugaucaaacaguaucucccagugacccugugagcaucuaggaacccagagaagggcagcauuccagcaggaggcgaagggcuccugagcuuaaccgaacuguuaggcaguuucuccauacugggggaaaagauuagccaccgcgguccccagcugaaguccccagggccuguaagagcagcugcuggaguugaggauugcacuguccaccugugagcagcagacggauggguggacagaggcagagcacggggaaggcuaggcgccaaccacuggccuuccagccucaagauuuggucaguccuuguuuagcccuggggguugcggggggggggggggaagggagggaagaagagggaaggacagcagccugcagggggcacaggcuucgucuugcccccuuuuuuauacuggccuucugucagaagcagaagggggagcucccugaccgcuguaccuccaagaggaaccaaugccaggagagcaaugguggcaugccccugccucggugcaggucucagaggagcagcugagggggcugacagggcacccugacaugugcacacauugggacucucaagacaaccuacgugugggugccuccugcccucaaaaccugggaguaccugcucucuuagggauagaauuugucagucauucaaucuguagagaaaguucuguuccaaagucagccagcugaggaugggccggggagccccccuccacuggcgugcugugcucauggugacugcuggguugaaaaguaggggaccaggugaggagaaagaccagaguugcccuaggaaaagugggcuuuuggagacagagcaggaagaggcugcucauuugaguuagcguugcuuuaaccccagaauccagccuggccccucucugcuucaccuggguauguggccugcggaguggcugagguuaccaggaucauuggccuacugucagguacugagaagugugagauguauuauauauauauauauauaugugauauauauauaugcacacacacacaugaaaaacaagagugagguagauaaauguuugaaaaacaagcccccccaaaaaaaccccccaaaacugucccaucuaauacacacauacacagagauacauguacccuuuccucagcauuuaaauccauaacaggggcuuuucuacagugauuaaaacagguaucacaaaauaaauuaaaacuccuacaugaaauaccuucuuaauaagcuuccccccuccuuuucccuuuaagggcagaggcuaggaagagccacaagccugaaccuacagacaagccagacaacuccagcuuuccuuccugcaucuaaucuccagucacaacugcaaccaucaucauccaacaguuuuccuacuccuaauuuaaauauuuccacccagaagcaucucucgcgcugucacugcucugguaagaagugcuaaaucgaaacaagacaggaccccucccccaaccccacuccagggggaggggccuccaagcccagagcuccgggauucugguuaaggaggaacagcaaggggcucuagggccacuguagggucagcucuacuccacuuugggauuuccggcccgggagugggcuuuauagcacacccacuaaaguugcugcuccuggccauggggaguuggugucuuacaucuugcucccagggaggccaccccuucagacaagcugguucuaaagacaggugggccugcuugugaaggagguggcagaugggccacuggaccagcucugcugcauccuggggacucagcagcuauugugugugugugugugugugugaaagaucaaauauucauuuaaauaauaauccaaugacuauugucugcaguuaaaacugcuauuguauucccaaauuggggugugugugugugugugugugugugugugugugugugugugugaaccaaagcaaggagagaaagcaaagugugacuuucaacaacagggacuagaaacacuaaaccaggaugugugggauuuuuaaccuuuuuguuucugaccugaguuuguggcaugccuugcccuggagcagaugcugugugcggggaagcaaggaaaggagagaguagggcccaggagucugugggcucuggacucccacccuccccacucccucaccugugacugugcucacagagccuauggguuagaggguaaugaauggggcugcagggagcaggggaagggagauguauuuauaaaaaaggcaucaaacaguucacggcaaguuauguccuagaagcaucaguugccggagaagaggaagaaaaaccacacucuagugauaagcagaggaaguuucuuggagugagcagaaaggaagaagggguagaccugaaaguuucauagauuaaauccacaaagauaaagaacaaaaaaaaaauagcagcuuuucuuuuccuguacagauguauagaugaauaucugaacuguaaaaaaguuauaaaacugacauuaaagacgauguguaugcaaauguuucacggucuaacauagaacugagagacccaugaagaaguccuaguaacagaccaugugaaagcucacacugcuuggauccacugccugggcgggcggcuccaggcugcuguggcucugaaucccuuccucgaacauccauaaccaacagccaggccgaguccccggaacccuuucgaguguguggcccucaggggaggggcaggagggaggucggggagggggacgaggcuggugugaggaccaccuugacccacaaccugaccuucaagcuugcccauggccacuuccuccagaauucuuggggugcugugggugggggagggguggagaaccaguucugcuuuccccuucuucaaggagggcgaguuccaucuuguccaguucucccaaacgguaaccaugcaacgagacccaggagaugugggcugggagagccgggcacaguggggggccucagcacgugucucucaaauguuaucaucaaccagacaccaugguucaucccacgccucuggacaaagggaaaucagcgcagggaguauaugcgugugagaaaaaccaaaccgaaaacaggauuuuggcaaaaauggcagcgugaaaaaugauagccacggaugaacaauggcccuuuuaaauuuuggggugacccuaaaaaagguuaaaaaaaauuccaucucagugugugaauuuuuuuucuuuuucuuuccuuuucuuuuuuuuaaaagaccuacggugucaggcagguguaugcggggugaugaggagccccaggggcagccauuaagucaaucugauuuuuuuuuuuuuuuuaaaaaagaaggcuucccagaugggcguucacaaacauuuuuccacuguaaagcagaaaagagagaaaggagagcguggaaguggaaggggagagggcagagagggaaggcagaggagagaaaaaggcagagaacgaagagacucaauucucgaguguccuguugcuauuaaguguugucauuaagguuugcagaggcccaugucaguuaaggguucggguaaaggaaauaaaaagcugcuugcauauugaaaaaaggaaggucccaaauguguuuacugcagagaagccgucucccgugggcagcaauggcaggucugaagauccacugagguacaggaggcuugugaauagauuguuacaaccugcucuccccuccccgcccccccgcccaccgagugggcgcacacacguuacuguuggcgcgugcuucgguguguccgaggaucagcaggucgaggacuggggcagaggcaaggcccucucguuggcgcgucccccguucaugugagcguaaggcugucucucaucaaaacuggcgcggagaacgagcacgccagggcccgggccauucucagccuuguguccugagugucuuucaggcagaggcagggaggcugaggaggccgaaggguccagugggacgcucuccauguucucaggcuccaucuccagcuccucuggcucgggaggcuuguucuccucgcuguaguagaaggagaccuccuggaagcugggcuccaucucauccuugaugcugccgaugaucuccaggaaggagggccgcaucuugggguuauacugccagcacaugcgcauaaguucaaaccuaagggagugauggggaagaaaggaaugagcugccagagagacccagaagaacuguaccaccucugcacucucugcuucccaucuggaugccucuggcauccugccauguaucuugcccagaacccaggcccagccacagugccaagcccagacucacuucaagucuugguucaccgauuccaccauggacgguuguauuaaugauagcacugcuaagagauaaaacccacuuccugucuaagcaccucuucuggccacacauuaaccagaagaggaaaccucucucucucacuaaugagaaucacagcuuuccugacaggcaccauucucuguaucucacaccagggcuauuucuaaguuucuuccuggcaccagggcgccccuggcagugggccugagggaggaggcggcaggggugcuagacagacggagcacauaucccaagcuugcuaucucacgccagcaccugcucacugaggaugucccaugaaggaagaucccugucuugaagauguaggaugcccaggagcagaguucuaauagaaacuucaagucggaugccaacgaaccaagggaaguccuaagcaucauuuucuucuacaaacaaggccaagguaaaaacaguauaaagcccaugacguaccuccaucacucccacaaggucacaaaccuuugcaaagcuuccucguccucgagaguuacaugggccagcuggcacacaggacagaagagaaaggcugcucaugcagccaccguccugaccagcaaaggccugggaguagacaguggaggagacccuaagcaagugaagguguguauugcugacacgugcaaggccaugucaaggaccccaaugccccagucccaugggaguggcaaagucuaccccagugaugcuugcuuagagagaugguaaagccuuccccugagguccgaguugcaagugcugacagugugugcagaauauguccacugucacguccuuccccuggaaguuuacagccucaagacggcuucccugcagagauggcuaaaccugccuccauguucagcuguauauaauaauccugcuuccuuguuuaucugcaugcaguaaucugccucucuguucaaauauauacgcuaaacauacugagcuuccagagcccaguccacgcaguccccguuucucuauacccaagugcacacucuuuguucauucccuugaugcccucgucaagucauaguucugcaacccaggccaugcagugaaccacaccugggcucugacggauggacagacacacaggcccgacagaaaacaaggacaggguggucaugauucugagggaaagggguaccuagcagcucucaaucacaggcgugugagaccaaagcacucuccaccuaugcuccuccaggaaacuguguuuuauaaaaacuccuggcucaacagacgcuuuacacuaaaacccacaaauggaaguucgaacauauaggaaucucaaagcacccugaacaggcuucuaacauucuaccaggcugaucacugggccaccaggacacuucuuuacaaagcaaauaaucccacagggguaaaggcgugugaaagcaaccuauugguaggcaugaaguugccugugcagagaaagccacucuugcccaucuggccagcuuccuuggacucuguaggaucaagucaggccagguggaagguaguuaucuuaaaacugaaaaaaggugcauuggagauccaccuccaagaauuaagcacucuggaggcccagggugaagccaaccaauuacagcggagccaggugcagcuuggagccuguuguuagcggaauuguaccagagcagagcugguuacacagcaccuguggcuguuucuaagcuccuuuguaggcugaguaguugagacagcggcuguuuagcuaggaaccuuacaauauuuacugccuacuccucuggagguaaagaaaaaucccaauuaaguggccaaugucucgacggaggaaaacaaacuggaccaaagaccaggcuaacuagguauucucacuggcucuaagugacugguccuaguggcacaugacagguugcagguagguacuaaaagcucuaggcccgggagucacgucaguccccgagagccagagaugucucuuuacuccaaugauuacaacacauccucauuguaugcauaagggaaaagcaccaaccacagcauuugaucauuugucugaagucacacagggagugagcuggaacggcgugaggcugucagacaaugcagcuuuacuguaaguaaccauggucuugcuagcagacggcgcucucccgacugucuacagacagucagaucuccugagccggcuugcucugguuagcugcugcagaagcuuguucuccccgguccccaucauuucccgaaggauuaaucggaaugggaagcagacacaaggagcuuagcuccguggccaggcugcaauuuccucucuggcugacaggccuagcccugaauagaaaagugcaaccgggggcaagaacaugagaugugucuggccccaagccccguggccaggggugggggguggggcugaggaggugccacgggcaggguagggaugaggugacaucaguaaaaacaagccaugugaugccucuuuuaaaucaucccagagucagcccuuccagggcugcccauaaaaggaagucuuuuuugcucugugcgauuuaagaccuuguuuuuuuuuuguuuuguuuuuuuuaaauacucuuuccacaagaaaacucuccaguagacucugggauuaauaagcugauaaaaugcucccucuaaaaagcacacuuuaaaaccacuggacagcucugaugagcuggagccgcgauuuacagaauaugucccucugugaaggugcacaccuaucccucuagaagugagugcuauccugggguguacgcccaccgcuaugcccauuccucacuuggcuucugagcccccaagcacaccccgugucuucagcuggacaggcugccaucuaugugaggcacuggcaaacugaaauaugcccaggaccucauguauacaguaccccugcugccgccuguuaguacuguaccagguaguagugacucuuagcagggaucagacuuucagaagggccuacgggacugaguggguccuccucuagcaucucaagcaacuaagguuguuuuagggccaggaccuagacggggaugcuauauagcccaguugcuggcacacagucgaugccagggaccguccagcagacacugucaccugccugugaugacucuauucaauuuaucucgacaaaaccagacugggauucccagccuccuggggguggagaggaaaaguacagaaguagucagauuggacugaguaugucucagcugcaucugagcuggugacgcucggcuaguaaaacguucaaguuccuuccugaaucccgcaucccgaagacuuggcaugugagcucuggagauguuaauggaucaaauggaucaauucuguggcugagcuuacaucgucgucccauucugcagcacgagggcuggaaccuguuucaggaucuccagguuccgugaacucugggacuggccccugaccucagcaggguucacugacaaaucuguguccaaagcccugaaacccagggguaaagaugggaaugauaggcuccccugacccagccucacagaauuugcuagaucaauucaaacugagcuauugcacugacagucagaccuggauacccugguguuugguggcagccuuuccucuaaagcuagaacacuuuguaauacacaaggcuggauacuuagcuacuccugaagcagacugguucauguguagggacgacgagaccaaagcauggccagagaaagggcuguuccugccucagaaccacaccauggaaguccuuccucuacgugugagacccaacaggcuucagacuacucccaagaguguuugcuuacugugccaaaaaaaaaaaaaaaaaauccuuucacagaacacaucuuccucucaucagcgucucagccaaaucagggcaccacacucccuacuggagcagcccggcucccuucccuucacucuguucuuuucuuagaaaggagaccgaucugccaaggggguucugaauggcaaagcaaaaaggccuccugaaucaaucauuucgcauccaagagcggccuccguguguaagcuuccuccucucuaugcugggaacaggaaguccacugccuuucccauagcagguggcuccuucccaagcauauuaaauucauaccaaaaaaaaaaaaaaaaauccaggcagcuggggauggaucaacuucaggaguuccaugaguuucucagacaaauguuugcuccagcauaaaagaaaagaaaaaaaccaacaauaccucuccugugaccaggcccaaaccacaggaacaaaacucacaccugcucuuuugaacgguuucucagcucgugagacagugcugauccugguauccuaaccaaggcugguggggcacacccuuacacagacucagaggcagccaugcuccuacuccauccuuucaccuuugcccacauacugacuauucucgcaauggacgaguaggacugcccugcaccacugaggucaaaguaaagcuauaacagcacucagaacccagagcuucucuaggcaggcccccugcauccuguacgccuucggaggucaguuuagaaaggccacaguggcaguguucuccgugaagaugcugcagggcacagcaggccacggaccagucaguggcucaauauggccugcugucuauucaguuuuguaaggcccucccaagcaagaggguuuuuuuuuuuuacacuugccaacagcuggggcaaaaacaaacaaauuaacaagucccccacgccccacccccaaauaggaguauuuuauaagaagaaaacgagaggaauucaaauuccaauauaaaguuuuaguugggcaccagcaguaacacuggcugcaauccaagcacuaggggaguuugaggcaggaagauuauccuaaauaccugggcuacacugacuccauccuuguugauuccugaaucauaguggcagagcagaggggcuggaaggaagagugagcgugcgguccccagcaccaccaauccucuccaguguauuagagaaauccucucagucuauggagugguccacagagaagccacggccucucccacuacacagaaccaucacuguuccuaccgcccuguaguaaauccgaucuccuuacaaucaccccacguaccggaguaucuucaucugcgggaagcccugccucugaccagcagcuaucuucuggagacccugagcuagcuagugucaccucaucgagcuccuccuagguuucauuagaaagccugugagaugacauuuucaacuguuggagccucacgggggacgaugcuagcccacaccuugacaucucaagauucagaguacagucacuagcaccucucugugcucugcccaccaccugcacugcacgcccaaccucuccaucuguacauugccucaccauccaaggcgccacgagagugagcgcugcgcuggggaagagaaggccagggguaggcagagucuuuuguguagaagugaagaaaucuugacaaccccccugggauucuuucacuaguggagcugaaccuguuuugaaguguuucugggaaacuguauggguccugacauaucagugggaaccugcuuugaugcuuaaccccgagaugcagagcaacagccgagccccaccuuaacgugugcacaucaaaugcaaguccacugcucucaaccuguacucgaugagccaaucggaauaccuucaugucuuccuugaaaccucacuccaagaagugccauucucggggcuggagagauggcucagcggguaagagcacugacugcucuucugaagguccugaguucaaaucccggcaaccacaugguggcucacaaccauccuuaaugagaucugacgcccucuucuggugcugucugaagacagcuacaguguacuuagauuuaauaaugaauaaaucuuuaggccagagugaguggggccgaccggagugggcaaccuuuguucccagcaaccacauuaaggcucacaaccaucaguacagcuacaguguacucauauacauaaaauaaauaaaucuuuuaaaaaaaaaaaaaagaagugucauucuccagacccacugagccaccaacaucagaugacaaagaaagaccucuacucaagagaguacaaauaaaaggcccacauguggaaagauucuuccccaauuuuggcaacaccagguaacuucugagggguggagccuaggaggcugccaggucauuagaaaguuaucuucaagauuuaggacuacagcaggaagauugugaaccccuuuaaugcagggguucucaaccuuccuaaugcuguguccccuugacacaguuccucaugucguugugacccccaacuauaacacuacuuuauaauuguaaucugcuacuguuaugaggcaaaauggaaacaucugugcuuucuaacggucucagguaacuccugugaaggggcaaggggucacgacucacagguagagaacggcuucucuaauggcucccuuucacuuucaagccacaaagugagacugugcgcucugacacaccuuuucuaccguaacaguuaccucgccacaaauccaauggaccccacugccgcucccacacugggagccaaugugaaaugcuucuccuuguaagcuguuuaucucagggaguuucucgagucacacuggcugagcacggagguggacgugacaccacguguguacugccaucgagugacaauucucacaaccaaucgaugcaggauguuauuuuuaacagaaguggagcgaggcaaccaucucaccaacccccccuagggugugccuacaagcauguccaaagagggaugagcucaaccgugcuguagguccaugcagcucgaagggauuaagaagacagcagauggucugugaccuugugcuggggcucucugagcuuuagucuacccgugcaagagagugacuccugaccacagagcucugugugagcaugcuguauagaccuuccaggggcuuggggagagcuuucaaaucuggcucagcaguaguaacuaacuugcauuuuugucuuaaaaauuaaauuuugcaugaaaaagaugagccaggauugcucauguauuucagagaugggagauggggggggggggguagugguggcugagacgcacgccauggugcaaagugccaauuagcacuggggggaccaagggggcacaggaugagauuaaggagcagcacaaagucacagauccaacaagcucagcagcagcaggauagagccuuucuaauccucuccuguacccacacacaacggaguggguggcucuggaaauacauacagcauaucagggcaguuguccggcuuguccagaaggccacccuccaugacgaaacgaagaacuugcucguuggacaagcccugguagggcugcucagccagcguggcgaucucccagaggacgaccccgaaggaccuacagguggaacagaacaggaacagcucagaaagggaugggaagggccauguccccuccuugccagcauuucuuagacucuggguccugaaaaaaaguguccucaaugugacgacugcacuuuguggacaucaaaccagccagcuugcuacgugugggacaucuguuccccuuugucacugcuaaggcuuccuauagggcuacugcaacccagggcugagguaauuaauguuaggggcuucuaacaucucucacaguuuuaagagcccgaucuacagcggacacauucagugucuggucccagccauuacuuggacauaagccaaauuagcucuaguucagcaaggaaugcagaggaccaggucccagccuggccacugaccugagacagcuaagcaucucaacuaucuccugcagggauuucuuucaugccagcuuagaaauacugaugcuaaugguucuccacgccuccgcaagaagaaucugaucaggguucuuaaaacaauggguaucuugggcucuccaaagcaauucugaccugcugguuguaggguagggagcugggccuggaaugucucaaaguucuguaggaucuugacuugggucaaggaagaugaaaacucguccccugcagaacucaggagccauggcugcagagguggcugugucaggaagggaacugggguaggauacacuggccagggggugugucgcaauaacaaagagucccuuggucuagaggcuggcugagguaugaacucaucaggcgaagcagcgaggauucuacugcgugagguauggccugucagcccagaagauggaacuaaaggagauccaugcaugcagacacuucagacagacaauggucacacugucgcucagugugaacacaccuucucagggagaacccuugcuuucacaaaauucuuccuggccugucugcucuuauggucaggcuguauggcuagaaugaagaaggcugcccauggcaagccaacacaaggcuucggauggaacccuagcagggcugagccccacagaagagccugaggcggccauuuuccacuuagcacucugaggauccuggccuaagcuggagcaacagccucugacugcaucuuaacuuuugguucgcagcuucaguuuccuucuaggaacaaaaggguuuugucccaacugaugcuaagcaaugucagacaggaacagaaccucagcaaucagacccaaguuccuugggaaccggcagucacuaagacagacagugcaguuacgguuuucaaagaccuggcccuagagaagcagguuuccuguguguuucaggccuggguucugccuugcagagccuuuguggacacucggaggcauucuuuagaggcugcagugcucacccucaugucugaauccggccugagacaagcagugauguaugugguuuucucuuuuuaucaaccggucuugaccagguucccuuccaagccgacuccccuugucuuucaugcuuucccuggugcaccacaggcuuucaggcauucagucacaauccuggcccccagcucuugacugccaugucuagauugcugguuacuugacucuacagacucagcaugucagcuccaguguaacucuugcuggcacccuguucuccuccuggacucccugcaggccaacuucccauuccaucccaccccaucucagcagccagucugcucauaggacggacaggaagauagagaguauaaaucagaaagaacgaagacguguaagggcuggccuuccugcccuugugagggaggggacagucccugggacaucuccccagaagcucaaauaacagcugugauaaaugcagauggucaggguguggcuugaccugaggacaccuccccucaccauguuccuaaggucuccuaccaagucaaacaaaauccuuccaacuuuucuuuggauuuuuaccuacuucugacugugaauucauucuaaaaugacugcaauuccucuagcaagcagagguucaggcagagcugagcauccguuuauacguucuaguguccuugauguccccagcugugugcucaaacaccccagcacuuggccuuuucucuucacgcauuuucuuauugguuuguaauggcuacguaauccaaguggaggaaaccugcaggaagcacccugugcgccucuggcuguggcaugcaguuguuacccagagucgggggagaaugagucugugcucacucuuucccuauccuguaaggugaucuccaagcuuccagaaaaaugaagcuuagaacaaacagauggaaguguggcccuaggugugcccucuccugcgaccucaucuacacauggaacagaguucuuugauucgacagagaagauguaaccucggagaggcuaauugcagagcagaccucauccuagagucgggaaacaaccaggccgcgcugggucauauucaaaggcuauuuccaauuugcaccugucuuccaaacaagauccaaggcucuugaccgggaaagguucacgaggcuaaagaacugaugucagucacuacugagauaguuucucuguguggucauccgcccuuugaauaaaccaaccaccgcuucuucugugacacaacagcaacgggaucucccgaggagacagccaagacacuugcugacauucgaggagggggacgacgugccagggcuccugccugccaagaacuccaguuguauuuuggaacccgaugaccuccacacgguguuuccaaggaacugcaguaaacauuacuacagagaagucuuugcacccucuggucagugugcuacuaccgcaagacacuuauuauuaaggaagaugcuuugggucaggaauaauggacaucgugugugugugugugugugugugugugugugugugugugugugugugugugugaacagaugagaccaacagaaaaccacaaccaccaagacucaaguuuuggguuuaaauaaagcacugccuucaaucugaagguuucgugagcugcggcaggagcacauacauacccaguaccaacucacugagaguggggaagagagacgggggaacaggcagaggcgaaggcauuuccccagucuuuggaaauauaaucaauauuugcuaaaaauggaaggaaauguugguucuaccuacuccuuggcuucccacagauaccuuuuuugcuuuaauggacuccacacaggaauaucuaaaagacaaagggcuaaacggcacugagagcugaacucaaggcuggcaguuggucacagugaacaaaacaaggaggagaaugagccacgagugagaagguccaagcuggccauggagggaaacucucauaccagacaucagaaugaguagugaagacaccauccuugagggacucgggagacauccagcgcacaggcagcaaccccuucccgccuuuccgguaguaguccgucucguagaugucucgugucauaccgaaaucuggagggaagaugcacaguuacucggcuggaccaggucuuggggcagagcccuguccuuccccccauauucaaggugagacauguucuugcuccacucugagagggcucuagcaucacagccacuucacaggagaauacaagacaucucuggucuucaucaggcuccuuuaagaaauuaacucccuuauaacauuuaaagcgagaggcaguuugcaaaaucauugaguaccaugauuuuucaagaaaauauacgccgcacagggugaggauauaguuuuaaaguuugguccaauacacgggaggaugaagaccccauuuacuugguagugugucucuacugcugaggaaaaggccuuuugccacuccacagaggacaauguacgaaguaagaacucaggaagauaaaaggacagcaaacagcugagauguucuucaccaggcuccuggagcuacuacccaacacccuuucccaacacaauacucucacucaguuuugaaaauguuuuccauuuucugaguuucaucauggugaauggcaggcuugcuuuuuuauaaucucacauuacugugucuuuauccauuuuugauuuuccacucaaccgcaccaccuuucccucacauaaacucuugcauucuccuucccuggagggaagagcugcucaaccuuuaaaauguccccucgcaccucuaaguggugccacaaagaggugagguacaaaaaaggcagagcaaacccauguaggguuugcucugcauggauguuaacccaacacaauugacuugcaccgcugucugagcuacuggcugccucucuugaacugauuuaggguguguaaucccugagaugggggcacugggggacacugaggaaugcagaacucgcccgaggaggaaaaaggaagugcuuaaaucucaucucugaauuaauccagagacaugcaaaugagaggaucugcuuugacuugcauaaaaggggaauucuagaaaacaaucucucucccuaaaugcaaaagaaaaauagaacaacccccucuucccaaacgggcacacacaauuuaauucuaaaaagaaaaaucauaauuauaauagaaaauauccucauaaaugcgccacaugguuaagcagaaaauauaauccuuacugauuuggauuuaaaauggcaaaaagcacacgcacacacaaaagcauuuuuccaacuguaaugcaaaaugggaccaaagcagccucucggaguuccuggcugugcugagaagggugcacagcaggguaagaugaggacaggggcacaggcuugcugucccagcccgccuccuccuccagcucugucccaauccacucucacuccacagguggggaaagauggcacagggagggaaggcaccugccucaggccacucaggagcacaguuuccucugaggacuaaaaucuagauccccacacauaagggagggaugggaggcaggaaggaccacaaaggcugguuaagaggaugcgccucuuaucuagaaacucuggggcgggguauccucuuaagggcugcccaccaagcuaggcucccagggcuccaaauaugaguguacaaacccagagacaggcuggggguaucuucaguaacuccaaugacugacaucuguucuguaacacagcugcaugccaacaccccuaacuccugcaaucagcaaagaagagagcccgacuuuggauaccucucuagagaugacacccaucgcuuacuaagaggccggaauggcucaugcaaaaaccacuucuaggguugaggcaagcagaacaucuccaggacacaagcucaagaggcggccaaagguuaguggcugaucgcuucugcuacaucgucugucccucugcuuguucucaggauggacacuuguuauguuucugaccugcuggccuaucgcaguaggaagguaaaguauaugcaggaugguuuucugagcaaccuuguuacuacuuuuuuuuuuuuuuuuuuuugaaguaaaagacaaaaaaacaaagccaauauacaagcuguaaggcuggggagaauuucuagccaaugaccagagauguaaugcaaucaguguuuuaggaucacaauguguuggcagcaacaagguaggcugagcagcuaaggucauggcaggaagcuaugcacgacagaacggccaagugcuuggagcuaccacugaaggaugcaccucaguggcuuaaccagcagcauacaucaggcccucgguucaauuccuggcagcaggagaggaggagagaacuuagagccgaccaguccuaugagugaaaagcagucagcagugaucucccgcggacugacaugaccaccauauacccuuccuguuacacuaugcaggguuucaccauaggggcaccuggccucuuaggaaccccaugggccuauucagggacaaugcucuuuguaagcugagaaacuugagggguggacuggauggugacauucuccucaagccaaaaccacuucaggaagcaagcugccccgauuauuucuguaacguuugaccuggggagcagggcgccaaucuggacuaccauguuaaggugcucuccggguuacagccaggaauagacagucacaccgacuacauacaucuuugcacucaagggcgaggcacugcuccucucggacauaaugaaaaucucuccaguggcagacuaaugacugcaaaguccccucagcaccugugaguucaguuuagccugugcuccaaucuggaaagcaaaggacacaccuccaauuuugacugugaaaucuucggcuaccaugcaguuccuagcagcaaggucucuguggacgaacuuguuggcauugagguaggccaugccaucugcaaucucuccagccaucuggaucaucuugcuuaagcucggaggaaugaggacuagauuauucugcugcagauucaaaacaagacaaagccaugagcaacggagaccuuuccccccuaaccuccuguaggucuacacuaggagucguaaaugcauauuuacuuagucugaguaccacaggucaccugcagggagucaggacuugcuaagaaggacuagcacuucuagggaccagcaaucucuuuucccacccccucccaugcaugcaugugcauggaugugggggccugaagcuuauguugggagcuaccuucuacccacugguugaggcagggugucccuaucaaacccaaccuggucaacauagauugcucuggggaucccaacucauccuuccaaggcuggaaucacaggugugcugccacaccagcccagccuuuaccuggcuucugacgaccugaacucugguccuuaugccugugaccacccccuccccccuagucuuuucuauuuggagcaggacaaaaaugauuugaagugaaucagcaaguuuaggcauuaagcauucucagcuccagcuaguuuccauguuccuuuggcuuccgccaucaccaagugugaguaagaggaaggacagagaacccguacaaaggccacgugaaacagacacacuuccuaaguggauuaccacgagcuuugcuucccgugcaagcugccaggacuuauucgucuucauucccuucuucuaagguacaaagauaggaagacuaaugcuuuccucuuggauuacuguuuucuacgggcacugaggauaaccacaguucagguggaguucaccuuggaggggaccaaggacacugagcagcaaugaggaccaauaucaugucugaagaggagggcaagaugcugccuuaggaacugaaaagaauuaaccuaagaagugguaaaaucauaaacaaacaaacaaacaaacaaaauaagauaagauuuaugucuaagaggcugaugagaauggcuuagugggaaagguaccugcugucaagacagggggccuauguucaugucccaagacagguaugguaaaagaugaaaaccaacucccucaaggucuaaguagguaugcacaugcauaugcaugaacacacacacacacacacacacacacacacacuacacacauacaaacauaaaaaauucccaaagcuccgucaccccacucccaugugcaaaaccaaccaugacccuuaugccucaguuucccuaacugaaaaccuucucauacaacacuaugaagccaucucauuuccuaauguaucucaagucacaggagagcaugaccaggcuuggagaucacacuauuugggcuaguauauaggcccuuugugcucugaccacgaugaacacucaagagcauucuggcucuuggccaggguugcuaaguucucagcagaugccagacucuaggaggccagcaacagcccucuagcacguccaggaguacucuccagacgacauggcaugugaggaccaaguugagcucauuuaucuauuuaaccauuuucacucugauccagggucucuuccuauaaucuaggggauguccucagaggaugugccaucacaggugcuuccuugucacgcugaccuuuagcaccguuagggucuuacauacacauggcaaagcaggaccucugcaguuccgugacauguacuuauaggcucaugacacauacugcaguguauguguguaauguuguguaacuguucaacaaagagcugucacuuaacaugugaaaaacaaccaacaauggggacuuaauuaugugcaggaaagggcugggcugacauuuugucaguucaugguaauauguugucauucuuuucuucaucucgagaaagaagaaaucuuuaguuuuguuagagccucuuaaggugagcacacauccauacacuuaucuaaguaaauaagcaaacagcaauggggggagguagaauacgcugaagccgggguguauacacugaagcuggguauauauacuggagcuaggguauauacacugaacuguggaguauacauugaugcuaagauauauguaaguuauuuuuuaaaaaauucugacaugaguuagacaaaauuuagaucugaugaauuuaaagauuaaguuuuacuuccgaaagagacuuucguaauccaaccugucucuuuacauugaauuaaaauuuuguuuuauguuuguggguguuuugccugcauguguguuugugcacuaccugcccacggaggcccauggaggccagcagaacagugaauaccgacaguuaugagccgccacgugggugcugggaauccacccaggguucuuuggaagagcagccagugcucuuaacugcugagccaucucuauagcccuuucucucucuacaugaggaagcggaggcccagaggcaucuguuaacugaggacuggagguaaccaauggcaaaaacagccccgagagcacaaguuacggguuuacucugggcaugugucaaaggcauuaagcacauucugauguuaggaggugccuuaaaggaccacucuccagucuccuucuguagacuggguauuacugggguaggaugcugcugcugggagaaacaggcauagcuuuguggcucugcuaucaaugcauacaccgccuuguggcucucuccugaaacuucagaaacacacaugaggacauuugugaacagguacucagaacuaaaaugaaggaaccauccaucacuugguagaugauuacguuguggaggaaaagaaaacgaaagcuucuacagagaaggggagcaaacccagaaagggcccgagaagaggaaguuccccuuacagcgaaugcagagacaagcugcuuaguuagccacagguaucaaagccagggccgaagugagagccucagagccugaggcagccccaugaaaggcauuugguccagcaauauuucucaacacccccaucaguuaacucuuagugaggacuuagaagccaaacuuaagccaggugcuuguggugcauaccuuuaaugccagcacuugggagacagaggcaagcgaaucucugagaguucgaggccagccuggucuacgaagcgaguuccaggacagccggggcugcacagaaaaaaaaacaaaacaaaaugcugucucaaaaaacaacaaacaaacaaacacaaaaauaacaacaacaaaaaagaagucagacucacauaugcuaaaaagcuggcugugggcuaacacaacagaaggggacacuccacagugacuaaucaaaaaauuacacaggaccuacucagguucacaguuugaaaaucucacuagccuuaagcagaaucaugcagcuggaaugguuaucauuuaaaagcgcaggcacaauacuggcuuauugccuagccuggggaguagguucaggguuugagaagugucugaagcagugucggggcaaggggagagcagugugugccaucaagguaaggauagcaugcucacauguacacgugugugugugugugugugugugugugugugugugaguguguuugugaguguguaugcgagugugagagugugugugaguguguguguguguguguguguguaaugggcuccugaggaaacaguggucucgugcacagaccgggcugcgagucacucuggccaaaaccucugacaaccugaagagugaccuuuauugaguacuuacugaaaagguuaccagccacggucaugacccugagguaaagaagaggcucaccccgaggaccucgagaguaaacguaugcuaggcagucaaguguacuggaaagucagugggggaggccagcccggccugagugggaagcugugggaaggguuggccaugacacgugguagagcagcugggguugguguaagauguaggcagggguagcggggaugcagaaacaagagcacagagaugcuggagguugaaugggugggaugcagagacagaccuuccaaagaucccagucugccuacacuuggacaauccuauauagagggaacugacaagaaagcauaucucaaggcacucaaggcugagaagcaaauggacuuaaagacacguuuccuacaagccagcuccugaaaaaaguggaccaagcaagauaacacagcgaggaacaaaacugaccuccacuucuggccucagagaccggagauaacuuuugagaucaccgcgugucauuaguuccaugaugaccagggugggcuggccuugggauaccacacccagcaaccggaccuggaggaaucaagaaaaggacucagagggggaggggggcaucccacaugaugaccuacgccucucggaacuggguggugcuggggccuguagccaggagcagaguucuggugggagggcgagggcgaggcucccaccucaagggucuguggguggcaagaaugcaacggggaaacuacccacugggaagagggcaaggcaacaauucguagcuggccaaggacauacagggugguccuuucuguccauacuuucuguccaugucucaucuuggcuucuuaccacauggugacaauugaacuccuucaucaccgaggccucguugagaaacucgauucuuucacgcauacuugcagccucguuuaccgucuugauggccacucugguuucggguucauccuugaccacacccuuggccacuccuucauagaccaucccaaaggacccuuguccgagcucccgguucauggugaucuucucucgagcuaccucccauucaucaggcacguacacuaguaacagacaggauggaaacggcccuuagacagagauuacaagaugcuguucccuaagacccaccaaggagaacaucaagguacaaacaguccagcacggguacucaaucucugaggacuccaugacacuuugagggugguacucguagcuaagaaccagaaggaaaccaagaaaccuaagauaggaaaaccaaaucaaaccaaacaacagugguuccuuuuucauauccuuggcaaaaccccaacccaacaaaauaaaaaaagcaaauuagcccuaagagacaaagaaagugggacuucuguuuugccugucuucaucaagggauggaaauguaggucagaaggggagaacagugggaggggaaaggaccaaagggggucaaaucuccuccucccuggaugaagccagaggugagaaacauccucugcauggccugggugccaguuuacaggccacccagccccacuguaggccuucagcgcuugaagucgugcuggaaguaagacauauacugcauuuuaaagacuugcuuaaaacaaguaaaaaaagauaacuuuuaaaagauuuuaaaauuuacguauacaugugaaaaucucucucucucucucucucucucucucucucucucucucuguguguguguguguguguguguaugagcacacacacaugcacagaugugaggcaccacccguguuugggugccugggaaacccagaagacaguguuggcuucucggaccuauaguuacagauggcgggaggucucuucacagaggugcugggaacugaauuagaguucuccagaaggucagcaaggcucucaacugcugggcccauuuuuuuuuccagcuuuguauuccaaagacuugguuaaagcaaguuuaaaaagauagcuuuuauauuaacuguuggauguugugggcuaaaugaaaauucuaacagauuuaucucaucagcuuuuacacuuaaaaaaacauggcuacuagcuggguguggcaacaggaaacugcagucccaccccagcccacugggcauggagguuggagauggggucugcugaacuaaaggcaucuucagauuguguuucaaaacaccaagacaaugugucagccgccugggaugucuaucaguucacgcacuucauuccacuucuuccauagccauguccgacaacaagcucaagguggcugagagggagaaacucagucaacacuaaaggcagagacucaagagaagaguccucagccaucaaaagaaaccgcagaaaaggagaugagaggccagcccccacccccacccccgcagagcgcugagguaggucuugugcacuacaagcacugucucccuauauuccuccauacagcuguuuaacucuggaagcugcagagguuggauccaguuuaacacacccugcugccccuuucaccgagaucuagugacgauacagacugccugccuuuuccaccugagaggaaggagaacucacacguugaugaagaaaaaagcaggguugggagaugaaacccaggguucaaaucccagaugauucaaggugcucuacaggcuguaaaaugcaguuuaaucccagggcugugcuguguuguuuuucaagugauuugacuuaguggaaugcauacuguuuuaaaaccaucaauuuugugaauggcuguuuucccugcaugcaucugcacuguacgcacauagcaccugggugccacuggcacguggguucugggaaucaaaucaggguccuucuagaaaagcagccaguguguuuaacugcugagccaucucucuagccccggaaugcaugaaaguauuaaaacuuaacacaagaagccaaacucuugccuaacacaggugaagccuaggagcccccuuccaggggaucucuagugagggaagugagcgcugggauggagggggacucaguagugaccccacggcuuuggccugcacucugcaaugccaggaaccucccugacacggaccugaacagaauuccuucuccagcuuccauuuuugguuaugcuugaucugguuugagaaaaauaaauaaacgaauaguucucagaaggaagggggaagagaaggaaagaaaauaagagaggcaaguaagaaagaccaaacacaggcuccaucccauaacgccaguggguacagcgagaacugaaaucauaucaaauuaauacguaagaucuggaaagagaauaccugcuccaugagaaccauaaccuaacagaguuacugacagcccugucuaacagaggauggccagcaggcauggcaagaaggaagcccuagcuuagagacaggccugggaggggaaucacggcuguguuuguuuuuaugcuuuuagaugccgagcugcaguuggaggugggagaccccaccagcaggucaucacgguuaucagucacccucagagcacaagcccuuacuucuaagugaugucuuaagggaaggguguuuauuauaaauucggggcuggggaccccauugacuuguauuuugaagaauggaacauacaucuuguggugguuugaauaggaguggcccccacagacucacacauuugaaugcuuggucauuagggagcagugauaccugacagagauuaggagguguggccuuguuggaggaaguguggcaccgagggugggcuuugagguuucaaauaccaggccuaugucuugcucuauuuuugcugccugauccagauguagaacucuuaaccccucuccagcaccauagcaccaugucugccuacauaccaucauguuugcuaccauuacaacaugggccuaaaccccugaaccuguaagcuccuuuaagccagccacuuuccaugagaagagcugcuguggucaacggugucucuucacagcagcagaacacuaagacacauacuuaucugucuacucacuuacucuuacuuacuggcugauuuggggacaggacugcucuaucuuguucauacuugccuugaacuugcuauguaauccaagcuagcccugaauugacaacuuuucugccucaguguccccaguacguggauuccagguuuguguggccacauuuggcuccugugcauguuuuuguauuucauggaauauguaugucugguaauuucucaacuagaauucugucuuccaugggccucagacaacuugugacccugcagaggcugagcuugcugaggagagcagagggggaaaggucuuuauaacaccucucuguaaggauggggaccacugucuccauuuauuaccucuaaggauccaggcuggcuuuuaaugagaaucaacuacacggcuugcuugcugcagagcauggaguuaaaagcccaucacauccauucccugggaggucccugaaguuaguggucucaacccuuuuucuaaacucaauccagcugccgacuuuagccagaguaccucagcuuugccagccagagcuguucauaaacuucguacaauguuaucagcacuuuccuguagggcauucucagugcacucuugacaacagcaacaugcagauuaacucugggagaaagacguuuuuaaagcaccuuucagaugcaaugucacuuuguagcucuuugaggcaaaaggcuugugcugcugcugugcuugucaaaaggccaaacaaaccaagugcagaugaggugacaguguucucaccuguugaccuggguagugacaaguuuguucuugcuuuguuuugaaggggggagggagacuauuucucuggcaccucuuuucucuuuuauaauuauugaccuagacacaauggcugcacgguucuggcuaguuaggggacggaggcaagguguucagaucaucugaggccaggaguuugaggcuggccuguauaaacaaugcauauuuaguuucuugauuuuugcccguuugcuuucuuguuuguuuugguggugugaggacagaacccguucuggaacaccguaggcaaaugcucuaucacuaaacuacauauccaaacucacuucauuuguuuguuuguuuuuaggagaaagauagucuccguaaguaacuauguaacuaugcuuucaaguguggugcuuacccuucuaguguauuuucuaugcuuuauaggcacaaacguaugcacauaugccuacuuaaaaaauaacucugcaagaccuuuugcaaacagaaauaacaucauuauucugcaccugauucaaauucagaagaggcuguucuugacuggcuuuacuauacacauaauccaguuauaaaugauuaaagaaaccauaguaaaaccauacgcacuuacauggugcuuuuaaauuacaaaggguuuucucuuuuuuuuuuuuuucccaugugagcaggauaaucaaucggacugugucuuaucugggccgcaucuacuuacacuucuggagcaaagaaacauuccuccugaacaaacuccugcgcugcacagacccccaucuaaccagauucccuacauagcccagcaaccucacagcuagcucuuccauacaccacaucaugaggauucaggaggaaggcuugggaugucccuugugcagacuucccacggcucagcugugggagccugaacaaguccuucucagagauucuuuuuuugccugcaucuagauagacaugagaaagcuccaagggcuaaucgaggagaggaccccuccccagcuuacuuagaaggucugaagccaagcauaagcgcuaggggaaaaaaagagaccaguagcuaaaacacagguuccgagucagaacuucugagccauuuaauuaaaugacuuucauuaguuacugccaaagggaauguaaaugggugcauaggcuguaugacccuaaucaggauagaacagcagagggauuccaagaucauacaacgcuauauagcccucacuggccagggaacgccugcagccccacccugaguugauacccacucaggaugccuggcuggcuacagcaguccucugacuagacgguaguaauuagaaugcuccuuucacucugaugccacacuucaagcggcuaacugaacugcuuagcagaccggccaccggcaucuccagagccugguuucuacuggggcaucugagagucccagaaugucugacagucacugagugcuaaagauguuauuaaaagacaagaaggaaaugguaccaaaggcagauccugggacaaagguaucucaaaauuacgcaacgcuuuucuccagucagcaccugacagcucccauauucccacaccuuggccaggacgcuuaccaucagcugcgcugaaauacucgggguucacagaagcauacagcacuccauugcccaaccugcuguuauuucugucaaaaaaaaaaagaugaaaaccaggucaacaaaucccaucucuauacauuucuguaaauaccuuuucuuuuccuuuuuuucuuucucacgaguuaucuugagcaagggacgcaaaccaugaucacugcugacgggacccuugccugcacuccugauccaggccccgguaucugaggacaaaucuuuccacuuuugcccuggccucagauuagagcuucuaaagaaacauuuguuucuuugcuucacuggaaauaacaaggcccacuccaugggaagcuaaacuggcaugcuuggagaagcucuuacaaggcagcaaucugugugcuagaacagccagaaagcagacgacggguacagagaaggaagcaaccccucuccuguugcuguuagucauuaggaaauguccuuuuuuccccucugaagaaugucugacuaggaacucuggcuguccagucugcaugguauuuucccccacagacgagcuauguucaaguucaaaucaucaagccaaugcgccacaaguacugucuuccgcuggcccaggcacucaccucuuucuauggaagacauacagcaugauaaccagccccccaacgaucagcaggauggcaaccggcagagcaaugaucagaugcaugaaguucucauacgucgcugcagagacaaggaagaaacaggaagacgucacgcacgaggugaauaacuggcucacuucauuucuguguaugguuggaaggaugauaaaaccgccucuggaauagccuuuacucccucaucucacaagaggagucuucgaggagucuucuagugcugggacaagaccagcagacaaacugaauuguuuggagaaagguaaauaaauacagacugaagcacacacuccuuuaaagcacugcauauucugaauacagcaaguaauucugaaggcaagcccuuccuguguguaguuuuguggaaguuuagcugaaggaaaaugagcagacacucacacacuuacuaguugcucacgcuauucuuaucuuuuaagaaagucccacagacagcuugcucgccacucccguccccccaaagcacuggaugacacucccugccaauguugcucugaguguucuacaaauauguaaaaccaauucaagucugaacuugcuaccaguaccugggugguaaguaccacaggauggccuccagggguucaggucuacaccucugaaaauccugagaauucugccagauucaagaacucagucuguggacagguggauuaacauggauguacgcugggcauagggggaagaagagaugggggagcgaggguugcuuccccuagggaaacggcuucccgugcagaggaaugucuugcagaguguauugaaugaugaagggguuugguuccagcuaagugguuuccgccccauucuucagauugagaggagucaguggucagcaguuaagccuaugaacugcagcagugaccaggauauugagauguuccucaguauguaacacuggcaccuugaucuggggacaaccaacagcugucuaagugcacugaaggccugagcacugggaggaaauucuugcccgauucuguaaaccuagcugacucucuguagugucguggacacuagagaagaaccugcuacuagcacuuuucugaagcagugagcuucuacccacagauaacuagcucucaggccucgccagagaagccucuuucugcagcagauggaaaggauuagagaaaaccaugacuggucaaaaugcagggaaccacugaccaugggguacccaugcccaacugaugauagacccacaccacaacccccacaacaaaugcucauggaacacugcaaaauaagugcgugguacgauucuaagauccagaagcccagggugucugcugagggaugccaccuuuuauguaagacaccacccgcaugcgugaaucccaacaacgcgguuaccuaaacuugcguaaugacaauaccaguucacaugcuuugaaguguggggaaucucugaagccccaccccuagaugagaaguuaccagcaguuaauggcugcugagagagaaggaggaucagucuuuaucaggcauaagcuugcugauagguuagccaaucccacguggucaucccuaaacacauacauguaccaguaacacuaaaugagcuuggcagagcauguguguauauguauguagguguauaugcauauauguauauagacauauauguaucaaugugcgcacaaguugcuuagcaacaauaauuaaaguagucauggaacugagagaggugggcauggaagaagcugggagagggaggagccagaugguguaaauacaguacucaugucagaaguucuaaaaggcuaaaacuaaaacaaugaagaagaagcaucagugaacucuuccaaggccagacugaaaacggauucauguacugggaagaugagugugucugaggacacacugggggccucugcacacugccaggucuagaggaguuaagggaacguaccagucuccuguggcaugcuaugcaucgcuccagucagaccucaggaagaaauccuuuuccauaagcaagaucagagaggcguccuaacuuugccaggguugcacggauaacugacaaguuccaaagucagagccuggcuuuccugcagcccuggcucagaacagccgcaacccaguaacugggaggcuggauucccgucauguaccagaaagaaucaguaagacuccaguuaauaugggaaaacaaacaaacaaaaaugaguaugcggagaagaagaagcgaagggcugugagcuuucaucugagagcccaacggaaugcagaucagggaaugaaacggaccgaagugccuccaugaaagcacuuuagauuucaggcuuauaaggagucuauagcaacuauuggacacccaaguugacaugucuacacaauaaggauggcguuguggguaaaaacacuugcuauguuacccuggcaaccagaauucaaucccuggaaccugagaaucaacucuucaauguuguccucugaccucugcacaugugcacaccaaguacacaccaacaguauagagaugucuccuuggaaaggagcuggggacucaguggagacauguuccuggaccgcgagccacucaccaaugguuggucuaccucuaaacucuauucuuaauccugaaauacuacaaaagccaaaauuaagucuuuuucaaaaucgaugggauucagcaccuuccaguuucuaaaaguacucccacgugcgccucccugccagagagaagcuccgagcuuuccuuuuccccuaggagaauucgugguuuuguguuccugauucuacgggucagguuguucuguguucuuuuugaguuucacauuucaacagggacacagaggaacuggaacacauccagaaggacaaaacugacagaaaauugucuaugcaacuggcuuucaagaaagggcccaaagaccugagaauauuuaaucgggagggaagaagucugaagaggaguuuaauagaauucacgcaccaagauuuccuuaaaaacagcaggugaugccgagcuuucaaugucccccucugaggauuagacccaagaaaacugugcuaaacugcgucuugucggacaccgggaaaauuucccagaagccaagagcgcuagcacgcagcuucaaucccccugugggaugugccaacuuccacuggagaaaccccauuagaggaccucuuaagaguccccaguggcauugcagucuuagcuuuacaaaggcagcuacaaacaugcccucuccuaagaaaagccagacucacuuagcuucagaagucaagacugcuccuucagagaacaccacccaauuuccagaacuccaguguuggcuuaguagcacgacgugcuacagauaagcggaaauguaccccaaggcagagaugcucagggcuucguugccggccugugacguuauugggaaguaguggcagguaaccuuaggagcuggguucuagaggaagucaggucacuggaagcagguguccugugagagaacugugaaacccgggcccuuucugccuuuuggagguaaccagcuugguuccaucaugugcuuccugcuucugacauuuugucucagaacagcccaaaaguaauagaaucaacagacagagcacgacaacccccgaaacugugggggccaccccucuaaucaucucuggguuuugccacaucggagagcuacaguaacaucacaauggagaguuagcacauaagcuaacugaugacgcuaggcuacccagaaaaaaaugagaaaauucagagucuaccugacagaacucucagucucaucaucucucaaucuagacacaguagcagcagauacagggaauccuagcuuccugcuuacgguucuauuuacuucugucuuugugcagucacgaugaggauuuucgaaugucuugcguaucuuugaauaucuggaacuggcuaggugggcuaucgaagugugaacugacauaaaguuauacauguauacauauuuaccacauacaacauaucuuaaagcauguguacauuaacccaaucagcaucagcauuaagucgcauuguuaccauuucuguggugguaacacuuucuuagcaauauucaauaaugcuuuauuaaccauagcuaguguguuauaaagcucacucuucuaucuaccuaaaauuguguaccuuuugagcaacacccccuaaguuauguuccccugguaaccugcaagacucugaguucacccuuuuagauuuauuucauauauacgugagaucacgugguguuucccuuucugcaccuucuauuaacaguauuccauuacauauauggaccacauuuuuacccaggcaccugcuggaggauacuucauuguuuggcuacugugacuagugggccaaaaaaacaagggggguguagauuucaacacaacuaacuuccauuucuuuuggacugggauugcuggaucuguugagaccuugucugaaucaagaauccagaagagaccacgaagaacauaagacauuaggaaacaacaguuccccacacccuagauucuagccucaaagcugagcugagauuuugggggguggggagugcaaaaggaauucacauuugauccuguauuuguuuggauauuacaugaacacgaaauaaucuaaaaaaauuuggcuucucauaagacacguaaaaauucacuauguauuauuucaccaaaaagacucaauuuuuuuuuuuuuucggucaaacaagcaugcagcccuugcauuuaacauuucacaacauuuacuuuuaaaucugaauccuaacagcucacucagugguuucugugaacugugaaacauuauccacuagggugggucugugcaaaauaacgcacagaguaucuuucaaugcauccugguggauggugaagagcacagaggaggggaagacucugacugggauguuguccugcagauuccugucccggagcagugacaccagacgaucccuggggagacgcugagcgcugggucacccucaccgaccaggcaggagaccugauacucaacucaaugcuuugcaaaaugccuccacaccugagccacgaugagaacaagauaucuucuagguuguacgauacucuucuguuacucacaagagaaggcuccaaggcucagcaccuucccagcucugggaugugcgugcgagugcacgugcgugcgaguguugggguggggggaaggugaugguggcacagauguguguccacugugaguaaauaccaagugucuuccuuucuggcgugacaccuccguuuucuagauacggcuucucgcugaaagcaaaggucaccaauggaccauucuggcuagcuagggaucugcaaaacuuugacugucgaucuccugagcaccgaggaagcacacuaccgccccugguuuccgucaaggacuugaacuuagaucuuuaagcaggcacuuucccuaguaagccaccuccucaacccagccagcucuguucuaacagaaaaccagagagccccagaagcucagggcuucugaguucuggcccagccagcuuugaaauuuaccgugcgucucccucaauaagacuuacuuuuggcggggacauagaagaacacaggaucuguccaugacccauucccagagagggagguagccugaauccgggcuguauaguucccuggguuuagacgguugaguuuggccccuccguacuuccuguacuccugucuggacacacauucccgcugauccuauggaaauauaaggcguuaauuuccuacaagcaugggugagaucugacaucugucaacucaagucaucaugcugugacuccagcugcccaaccucuccuuacauuguccagaguaucaacauaaaggaagcaaggauaccggaaaagugguuuucagguuggcacauggaaaaugguaaucaaauauguugguaauuaaaucaaauauguugguaacuccagaggaauaaaagaucaucaagacgugucuagucugcggcuggaggccuagcuacaguuucauuguuuguaugaaguccagccagcuccaugcacccaaguuacuacucaauaaagauggcguugcuaggaagaccuuuauccuucccgacugcccaucuuucuccccugucugcuuagcagucagcagacaaccaguaugccauagcacgugcucucagcgcugaaacacaugcagcugcaggccaugguaucccucuuaccucgacuugcgacccguauuuaauuucauacauuaggaucaauccguugggguucucggguucuggccacuuuaaaaagauggaguuuucgggucuuggcucccaggucaccggaccagggauaucaucugcuccuucugcauaauuaauguaaacaagcagucaaauuggguuuagguccccagaaagaaugauaaacggugugcuaacuugagaacaacuguucccccaauccuuguauauacaggacucuggacaggggaccuuguaggaguucuuuccugagauggcugcuggcacagcgccuccauccccucugacugaaaaaaccuguggccaaguacaagugaucacgccugaaaaaccuauguaacauucuccagguccauuuuccuaccuaaaaaguuaaaaaaaaaaaaaaagaacccuucaaacagagcggcccuggggaagggcagugagcgacagcgugcugagccuccagcuguggcacugacacauucacagcccacacccucacacgggagggaggaagggccaguuccgaggcuggccucugaggcagcuguuccggccacugucucuuccagccaccgcuggccucacuucugguggugaaccacagcuguugggugacagcugaugacagccgagagaggccuggggagauaagcuguucucugucucuucuaggauugggaaacugaggcacggguggcugagggcuacacgggagugccaaagccgaucucagaagcucuuacugccccaguucccagcaugcuuuguucuccccacugacugacaccuccuccacgaaugagaaguggcaaauggcuggcagggugacaggcaguaucuaacuguaggaggaggcccacaggcugaucuagcugaccacgaggacaacgcuuccucugcaucaagcuuugagaccuggagggccccucacaggucuguggugugcuaaggccuuugugcucucagucuguagccucuggcacugagagaagacaggacuuuaggagauugggcuucaaugaaagaagugaugaaauacgauguguugcuucauugcaagccccaaagcagugagaggcaagugccuguggucuaaaacuccugaaacacugagaccaaaauaaaccuuuccuucugguaagacaacugccuuggguauuuuguaauagcaacagaaagcuaacucauucagcugugcacagaagggcacaggggugggugugagcaugugcaucgugaaccaagccaaggagugagagcccugaaaggggcuuguaaagagugucuaugguuaagucuggaugggagcuggcacuaggaauacauucucuguuccuuaggcaccugacggacgacguuguguaccaacaaccacacauucguaggccugaaucuaagggcugucagccucccccgccuuggcuguaaguuggcggcggggcuaccugccguaccugcuggcaugguucucgcaaagacgaaguuggaggcgcugcagcccagcuucucagccucgugguugcagcuguggauaucgaugcgguacagagugaaaggccggagguuggagaugacaguccucuccuuguuauccacucugcucucaaagaaaggguacucugucucgaacuccuccgggucugugauauuguaggugucagcuaccgugguguuccugcuucggcuggacauggucguguuggccacuugcaugacgucucuccgccuccuuucgggccugcaaggaggagaaagaaggucagcugcuaaguucuuuaguuuucuuugucuuuuccauggcuaggguagaaguaauaggaaaguccuagccuugaacuaaaagaaacuacuuaggcuccuuggauaagaaccaacaaauaaccaggauuuucgccuucacaacccauccuguacucucuugagacauccucagagaaacaugugcacacaugguucuaggaaacagugugccagccauuuuuagccagacagugcucuguuuuaccagacagugcuacuuggucaggccugauaacugagcauucaacacgacaaaccaucagccucauaagacugguugggaaaggugaggccuaagacacacaagguagaagagacccaaaguccaacaguaguggcuucuuugaucuucucugaaaugaagaugcccuaguuuaagcagcuagcaaguaccuaaaucccagcgcuuuuccugaggaacagggucuccuauugaugaaugcccccagucccuaguacacagcauggucuuggagguucaucaaaccuggcuuugcauccuccuuggcagugagcuugucugugauaggagcggagccucuguuacucacugacuuguguuagcuuaagaaacuacagaaaagcaacaggaacagagucuggggcucccucucuuccagaaaaaacuucuaacauucauaaaaacugaaaaaaaaaauaaauaaaaauaugacaucagauaagcagcccuaugggcuggaagcaacccucagguugucugcaggugaacagugggcaagcuggguauugaggcuguugcuggcauugcuugugacaggacaaaggaugagaggaacaggugggacugcacugcgucugguaagaacaugacagaguaagacaaaagggagccuagaguacggugcucgaggcgccuuggaagccaugcccaaggccuauggaugcucccuaggccaacaucugggagaguacaguagggaguugggggaaagggccgcaugcucccuggucuucagcagauggaucugcuaccaaaaccauaguucuuugucggguacugacaugccaguuuccauugaaaguauaucaacugccauaccagggcccaucucaaaaguuaggaauggggauuuguuaucauaaugcuggggaaagagauaggaaaugaggguacuauucuaccaugcucacacccagcaaaccauaaaccgaccaaucaacaaaccauggaaggaaagauaaaggaaacuacuuuuucagguaugugugugcgugcaugcaugugugcgugcguguguguguguguguguguguguguguguguguguguggcggcuaggcagauguucaaaacauuauuauuaaauuuccugccucccuuucaaaccagagcaacacaaacgugugccuucauguaagaaguugcuuguguuugauuuauugcaaaaugauacugguccacuucuugccuugacccacccccaacaaacugggcuauagcaccaagcagacucaguggccuccuuacuuauaaacacugcacucuugcauauuauucaacaguuacuguggacacagagucaggaccaugaagggaggcaauauaggcaucagaaggcuagggaugauucaaacagagugguccaggggguggcaaacagcacacuaucagcuuuccuuacuccauaaaguauccugaugcuacuggaaaaacuuguacuguuuaacaucugagaauguuuuagugacagaaacauuuuugaagcgucuucaaaaaugaagauggcggccaaugaaagccauuuacugauaccaaguuuaggaaguaacuuuauaaauaguagccuccacucuacuauaaacucacaggcaaagucagacaaugcagaaagacuaaaucugauauauuugccuucagcccccagauaaacgugcaccuagaaugacaugaagguaggaauagguuuuagguaaacucgguuguaugaugacagaguugcuccugucaucuagggugcuccuuuaugggaccuugcgagaccucguauagaugucagauccuugccucgguaggagguaaaaaacaaccccccaaacccuaauggccagguguggugaccccuaucugcaugcugggucuguuuuaggacacugaggugaggacacuuacacgaaggaaugugaccgagagaaaauucguuucaaacccacaguacaagcccugcacggucccaucugggucaaccacagccuugccgcccaaucacuuagccuagcguuacacagcugaugauaacagcagucacaaagugaugucaucugaguauaacuaaacaccaagggcuuucugcuauggucggucuacccuugguucucaugcuguauuguuagauguuuggucacuaguggggcagcugcaggaggaaccuuuagggaaugguccuguuagggggagauccugauguagcaaacaagcuaagugcucaacgucuguucagcuuccugucugcccugaaaucgcugcugugccauaaguacuuuggccaugcgacacacccaaagaugccuucaucaacaaaagccacacuggcuccuuguucuucuaacuuuaaaacuguugagcuaugcacaccacuaagcaucacgcaauuuguuagcaacaaugaaagaacgaccuaaaccucuggccaugccuacaggaguccuggauuugacugacacccaguauagggguggguaugggaggaccucugccuggccucuuugggacgcuccauaccuggccacucucauggcuacucuuacugaguguugguucagguggaaugcuccacauagauaacccaaugaagggacggagguuugguguuggagaauguaggucugagacccaagacucaaacagacaguaaguuagugaggauagaggucacugcauccaguuuuuaaagcaccuuuugauuuguuuccugucuucaggucuuuaaauucaaagaaacagacaugacacagaggggaacauggguaaaagccaaaacagcagcgccuccugucagcugacugcaauagcagcccagcagccugccaaccaacaggagcugcuccgcguggggcagaugggagcaugcacagccuaaggcaucaaauguagccuuuccaaagggcacacucaccugggcacaaagauggaauugugaaggaaauucucaaagacuuuacgguacucagccuccuccuucucagccugcuucucagcuucaguuuuagggcaagcgcagcauggcccuuuaucaccaccacacacuucugucuugggauuuuccgucaccuccuccacgucgaugguaccaucggcguacuuucugauggguauuuugucugcuuggggaagaccagagaugggaaugaaagccaugcaggaagugccuguuagcauugcugguggaggggaggggugcuggugugcacugcugagaagcaagcccugcaacgugacaggugugacccuggggcucagguucucucagacaacagacaaggccaguggcacugccugccugcugccugccagcccccagcucaccuuuggagcaguaguugugccgguacagguaaccauccuggggcugccgcugccaccucacaauguaguaacucaaguuaccauugggcagaguuggaggauuccacuucacaaucagcugagaggaagaguuugaugcugagaggacaucuaggggaauggaagggacuggaaagaagaacaaagaacauuucagagaauagaccggaauccgagguugagguuaucaggggcucgaugcaaaccaacaggaagcugcaggcuugaccugggcacagagauagcaacggaccaaccagagcaugaggugaaccagagcuuuggaaagauuaccaacugggaggccagcccucucucagagcacuugcucuuagauaaucuaugugcaaacacacauggcucacugaccugggacugaaggggcuacgagggcauagcugggguuaaaggggacucuaaaaaaaaaccuagaguugauucaguuaugacaacugucauucuccgguguguauuaggaaauggcaaauuggacggcuuaguacuucaccugugauugcaaguuuuaaucucugauaaaaacuugauaaacaugacagggagccaaaaugaagagugggagugggggauggacaguguguggggugguuaugugccugggugaaaggacugugaaacaaggagcagggacucacagaucuuguaagcaagucaugauucaggaaagccaguacgccugagcccugauucuaugcaaaguccuguuacaagcaaaugaguuuaacaaaacgacggaggcuuacauacuacugaugcccaggcucaaaaguagaacuaacuuacguaaaaaggaaaacaucccaggaccacugcuguguccucaccauagcaaaagagauaccacagccgaagcgcaccccauccccaacacacacacaugcacauggcaaagaaugaggcccacugguuuuggcaguuuccaaagugcaagagacagaaccgugguuaugacacuuaagaauaagguccaaccaagcuguuuuugaaucugaaaggugaaaacaagcuuguaccggucagucuuaugacaacuuggcacaaccuaucugacagaaaaaaaccucaacugagaggauggcucaguaugaucaggcuguaaggcaggccugcagggcaucuucuuaacuaaugguugguggaggaaaugcccagcucauuguggugaggaggccucugggcuggugguccuggggucucuaagaaagcaggcugagcaagccacugggagcaagccagugcuucuccaaaguuccugucucugcuggaguuucuacccuggcuuccuuaacggcagacugugauccugauguggaagucaaauccuuuccuugccaggucauauaccaccacaccaacaggaagcgaauggacagagggcuguuaggauguaugcggugcucaaggcucugagaaccacugagggacaacacguuggaagaccaagacugaugcagagaagacaagcacuugaugccuggucccgugagcguuuucaauaaguauuuccaaaacaguuucuuacuagguauuucaaugacaaguuucccagaugaagcagaggcacaugauggacuaaguacgucacuaucggucccaagcacuuuugaggucagggaccaaaugcaguuuuuaauauuuaggaagaagaauaggauuucuuaagaaucugcuauaaugauaagaaauuccugcuuaguuuuuuuuuuuuuccucucagaucugcugcaaugauucacugggagucauuacucccaaacuuuaagaugagaaauguauucaguugcuuugcucuuggaacggugaauauguuucauuguguuguaagccacucaagucgauggaauuuuuuguuguaagaggucagucauuaucuuuacagugaagcauaucuuucuaccucucucgucuuuggauacaaacucacaccuuugcuuuuccccacuucuagguucuggagcuggggaacuaguacguaaacacaugaagaagaugagaagggauuagucaauaauccgauaucauaguacucuaagccugcguucgccuguugagaaagcugguggcuacggaauaaagguggaaagccagcaagccacuagaggcaaggggugcaccggucauugucgucucagucccuggaagucugcacugagagagaggagaccagccacaaguggcuacauccugggcauucagagaaaccauccuacugcucuggaggacaccgauucaauugcguagagcagagauguugacauuuaagaugguaccaagucuaggaaauggcucaggagaacuuaagguguuggcagugagaauguuaauacaguguuaagcagcaacaacaagcaucucauugcuagcccuccagccauacugugccuauguaaauaaagcaagcuuauaaaaauucagggaacagggguuggagguuguuccuccggugcguggauaccugaagcauuggugcgaauguacaagauuucacuuuuggccccacggauauggucguuuuccaccauggugagggucacagccuugacauagacagcauacuggguccagggcuucagcccaugcaguaaaaugccaggcucgcccuccuuguucggaggcaggucuacauccaccauguuccagcuguuggagccacaggcauccugcccgucauauuccguaacguuuuuaaauggucugaaagacagucaacacaggccagagaacguugaagggcucuggcaucaaaacuccccagaaccuuccccaggggcugaacgugucacacuuucuauuucuauugggaacuccaaauaaaacucaucaucaauuagauuucuauacaaaaauaaaaucaagcaucuggacucgggagcucgacagcuaugaaccgcagaacugacaagcagccuuagagacagcaagucccucauucacagggacugaaaaugcugcgucuaagacaugcggaugcucauugucuucuuaagugagaguuaaaaacaacaacaacaacaucaacaaaaacccaacuaaugaaaaaaaaaaaaacaaaaaacaagcagagcuguuuaaugcaaacaauaaacuaauaaaacacaacuuuuggacaaaacuaacuuuccuaucccccuagaacucuaaaauguaauucgauaauagccauuuuuauuuauuuuuauuuuuacuuuuuugguuuuucgagacaagguuucucugugaagcccuggcuguccuggaacucacucuguagaccaggcugaccucgaacugccucccaagugcugggaucaaagaugugcaccaccacugccuggcucauaauagcuauuuuuuuuaaacaauuuuuuuaguagauauuuucuucauuuacauuucaaaugcuauccugaaagucuccuauacccuccccccgcccugcuccccaacccacccacucccacuuccuagcccuggcauuccccuguacuggggcauauaaucuucacaagaccaagggccucuccucccaacgauggccgacuaggccauccuuugcuacauaugcagcuagaaacacgagcucaggggguauugguuaguucauauugcuguuccuccuauaggguugcagaccccuucagcuccuuggauacuuucucuagcuccuccauugggggcccuguguuccauccaauagaugaaugugagcauucacuucuguauuugccaggcacuggcauagccucacaagagacagcuauaucugggucaugucagcaaaaucuugcugguguaugcaauagugucugcguuugguggcugagauaauagcuauuuucgaugcuuaacuaucucauaauauuccaacacuuuguuuccugauugucucagagaguggcauuggugauaccaccaguuagcaucgccagugcacuggcagcacuuucaaagggaagggagggcucugcacagaugcaugguaggcggggugucuacuuugacgagaugcaagggcugcuagcuacuggcuucugaaauuaugcugacaugacuuguguucgaucacgaugggagagggguggcccccauuuacacaaacacugagugauuuugagcuuucuauuuucccugggcuauaacaguucccaggacccuaggucaaguggcagcgaagauaccaggcacugccaccagcaccuuugcuucuggaaagaucagugccugggaaaacggaugaccacacagacuggggaaaccaccuggccacaggaggcugaguaggaaaaugggacagcucaggaagcugugauguggaguaagcaggaugguccuaucaggaacugcugacaccuagguucgucccucacuauucuuuaaugcuagagggcucauggcccagagcaaagucuuggcaaggccaugcaugcaucaagugacuggaagacaaugggucaguucaggguagccuuggugagaacagagcaccccaugggguauuuugggggacagaggcuaagacaauauuuaaccaaguccacauaauggcuuaugacaguuuggaggcauucaguucucuuaaaauucauccccuuuccccuuggggugaacuuacucaaacaccauauaaacaaugaaagggcugaggcgggacacucuccugacuagcugcugucucagguugggacaguuuaauaugacaacuagagaggucacaugaggaugaggugacggucgccugacuugauucuuuauagguacaccaaagacucucuauucagccaagucacacugccaccuggccguccccacccucaagcuugacaucagagugagaggcccaaacucacgccuccuuguaguaaacugugaagcugaugagaucccgguaguccggcggccgguaccggugccacguuaugaugauucgguucuuccaggucgugguggaggugaaacggagaacaucacuuucaccuggggcacagaggcacauccaugagugacagaaacccauccgucucugugaugucacucugagagaaaacccugacugugcuuccaaaggcaaaucuauggcuggcgcacucaugaccugucaggucaggcuggcugccccuaagggagaagcccuuugaaaugcuccgaucacaggcuucugcuauguucuugauggggaacaggucagggggcucugcagaaaggugagggugcuggcuguguacacacuuaccaccucugccuaacuacucuucucaagaugccuccuggauccguagaguaucagauaaaucuggauacucaaaagacaaggcuagcccuccccccacauguaugcacacgucugacuagcuguuggucacacagcuccugauuccccacuaaugcuauauaaugacggagggucaaauagagcuuuaguauuucuguuuguuuguuuuuguuuccuuaaaacaggguuuuagauguagcccaagcuggcuucaaacucacaauccuccugccucagccuguuaaguggugagauuauaggaguguaccaucaugccuagcuccauacagugcuagaggagagacugacauccaggucugggaccacauuuggagaggggcuggguuaacagguugaacucuaggcuaugagaucuuagggugaaaacucucaucaccaggauggaauuauuacuuuguccaacaugugaaaagcauuccgauucaaagacaugggcucacuuuguucuagaaggagcagggcagagaaaggaggccaagugugaggacaaggacacuggacguccacggaaguauuauaguggagcaucuacccugauccuucuauggcacaggagagaaaggcagagcugaccuggaguggacuggcucuucgguaaauauuguuugcucauauugaaaagguauuuaacugugcaagcucuaagaaccugcuuggauguuuaauagacucaaauggacccuuagaaaaauauaucaguaugaguguaucaggcacccgcccacuaauaugcagaggccaggcacuggcugcagugguuugacaguccauggugaaacaaagagcccgcccacggaugccaaagacuguuaucuggacuguggcagucccaggggucugagaugcugucacucacaggaagcucgcucuccguuguuccugguguuuauguccccuuugcucuggcgucccuugguuccggucacuuccuccaugcgguaaauuucggagacacacagcuugggauugaaagcaaaguacaucuuuccggaccugacggucagguuccggugguuccagucccacagcugcugcaaguucugguugucuaggacauagaaggaguaguuccuggaagcacagaaaugcgcauuagcaacgcacugagcccacagcccccucaggcgacagagagccucucugcggccaguguaguuccauaccaacaagggguuugcuugcuuacuggggcuuuauaacagcagacaguggcgguagccacuggcaaaaagaugugccaaggacaauguuuugaaaucgacuggacacuaauuaauuucaugaccucuauuaccaacacacaaagcuucucccaccaaaggauguuccuugauucauucccugggaaaaugccuuugguuauuucucucagagccagguauggacaaugugcuugaaaucagccuacaggcgaacagacaugcuccgcuacucaaccggaacagcuuacauacuagcagcaaaggcugccauuaucccuaggaauaaauccuacccaugcccaaucagcagugcaugaugggaugggagacagccuggcucucuguacauuugccucucgcugcaagaagccuucauuucagucccugaguacgugggagaggacagacauccagugucucccugggcucucacaucaggguagcuagaugcagcguguaacaugguggcuuuccacauuuaguauguacacagcuuguucucaguauccccuaccgcuagagcuucuggugcagagguccagagugcaccaggaaucucgaugucuagcagguaaugcugauaaacaccaguccuggguccacccagaaacuaccaggccggccacggcacuguuuccaaggccuaacuuccacuagaggggagauaugggcauggccaaagggaagauagcuaucuuagggggccaaggggagagcaaggauucuacuugggugucugcauaaguuuuuuuuuuuuuuuuaaacaguuauuucuaaauccacccacagaccagacaaacaugucccaaaguccuguucugcccuaaaggcuguguccaccuaggcaccaccugcugagaguccucacccacauuagaacuacugccuagggggucugcuuucaacaugaccuucacauacugagaaaugaguuacagcugcaggguugccaagccucucccgacacuuccuggagaacucauuagggagcucagaggccaggacccaggaccggaagagccaugaauuccccacaggacaagccacaggcaguuuccucggugcuaugaagagcagcguucaugugcguaggugaagucugaggucucguugguuuuaagauuccuuaugagagccagugagauggcucaugcgugcaagaguacuuacaucacaagucuggugaucaggaccccgagaaggaagaacaguuacuguguaaggcuguccucugaccucugcacauacaucccucucauagguaagaguccucacauggaggagucggagcucaagugugagcuaagcaguugaauggaagccccaacccuccuugagcacuucugcgcaggcuucagcgcagggucugcacacgcacgggcucaaugagccgcuagccuuugguaaggaguguuccccuaccaugcuuguuuauuggaguaggaaacaaagacccugaucaaaggaauccagaucguaguaccuaagaguguauguccuagggagguccuuggauaccugucagucagaacugccaccuacgggacccaccaauguucacucuuauugauauggggguggucaggauaggcagacaacugaaggauagguguaaugguggaaagauugggucccauuaggugucuugccuaaccaugggccauucuuaaacugcugccucaacgcuaaccucaccggucuggcugcucccaagucuugagagucccaggagacaaaaaucuccuguuauugaagacaccuccaggccggauacaagggccaacuaaucaggucaaacucccaucuccaucuaggccaaggccucuuaguaaacuaauuucucaagcaggaaacagaauuguacugaaaauaccuuccuucugagccacacauucuucuccccagggagggagcaugaauuagaaaccaggaauuugacaaaugaauggcaggcacauagaaacucaggguauuugacuaaucacuuugaaaagcaagauuaucuuuucacaguaaacacaaacuuucucucuuuaaacaaugcagagaaggcugggagccagaauaccaauaucaauaaaauccaggcauuguggagccuacagaagguaaagaaaaauaaaaaccuucaccaaaauaauaaucaaccugcuggggagggcccguccacacagugccugcuucccaacccccacccgaggccugccuccucaacaccuucugcaauagugagaguuaagagauauccccagguggagauuugucuacacaccuucaagauacuaauguccuugaauggucauuguuuucucagggagaugacuaguuaagggaaccacucaauaaaugcgacuucauaaaucguuucuaagcucacugccuuuuuacauccacagaauauuuuuaaaaaccaaacuguucauuuuuuuuccuuuggcuccuacacgcuguaugaucucccggaguuuuauugagugguauuuuggcucuuaguucgauccuuccuucuuuccuaccuuccuuucugcaccccccccacccccucaagacaggguuucucuguguagcccuggcuguccuggaacuuacucuguagaccaggcuggccuagaacucagaaauccaccugccucugccucccaagugcugggacuaaagaaaugugccaccacugccugguagcuuguagcuuuuucaacauuagaaaaaaaaauccccucuauuggauggguuucaccugccaaugcauagaccuacuaggaugguuagucaacaauuugggggcccugucacaugauaagcucacagccaacacuuagcuaugaucuguggcuaccauuucuaggccucccuuuuaagugaagacugcaggggaccgaguguagagucuuccauguaggaacugauaaccaggcccaagcaccuucuccacugcuuaugaaguggcaccugaaugguuuacucagcuucucuagggcugcugguucucagcugcccauggagcuaucuuuucuggucucuucgggccccgaggccaauugagaagaacuggaugcuaaauauaaaaggacguuauaagcuuugaaucaccucacaaaggcacaggaugaccugugcuacucucugaacugucaaaagucccccagaacaaagucacagaaaauagguaaguccugcaccuugauacaggcagggcugagcucaaggucuccagccuacacaggaccccucuuucaagcucuuacuggcauccuggaagcacagacaaccaauaacucauauccauuuuugcaaggagacacuacuacugccugugacagcugucucuagagggcaucagaagccaguacacugaagcugucaccaguacagucauuuauaacacuacuuagcccaucuguagaauauugguucacuucagguccacaguuauaccaucuacaaaggcucaguuaguauggaaauauauacccaggcaaaacuaaaccaagcaccacauagauugacaaaauaggccguuuguuccugagugcuuuuuaaaaacagcuuugcugagguacguuuuaccuucuaaaauuguucccacuauaaauauacagcuccaugggcuucaauaaauuuauacagauggccaaucaucuuucaaucauccagauucagaacauuuauaucaaacugaagcccccccccccauucuucucccauccaaggcauuuccccugucuguucacccaggaugcuacauguaccauuggcuaguaucuuacuguguguuuugcgcuuauacugaggaaccccuagauuauaucuaacgcaccauuuugagaaaauacuauggaaaauguugcuaagagcauucacaugugauauuugcauacacaugcuuccauaucucuaggaacagccuagacuugcuaggcaaaguaacuaauuguauguauuuuaaaagucccaaguaugugcuaaaaugugguuauguuagggucuaguuccagagaugcagggcacauuacaaaacccugagucugcaaaggguagagaugccuaaacagacuaagaauucuaacuuuauacuggcccccuuccaguauuuuuguucuguucaagacaauaaucuuuggcagcaccuaagagcuugaacuuuucauuuauuugauugcucccaaaccaaaguuguccaaagcagagcauuuuuuuuuucagauaauggaaauauuuucucucuuauucaaggagaaccacauaucccuauccccagacaaaacuugauuuuccuucuuaaucccccccaugacccccacacuuugcuagagaucagguagcaagcaccacacacucuagguuaagugcucuaucacuacaccacaccacuacuucugagaaaacccuuuccuuucugugucuguccuugaguacacagacgugcaggcuucuggacacaggagagagacacugggcauccuccuguuacucucuaccccacuguccugaaacaggcugucucacggagucuggcucaggucaggcaggucaucugacuagcaaguucuugggaucagucugucucagcucaccaccuggagcuacuccugggugcagcuaggcucagucacgccgaggauucaaacacgaggccucaugauugccaagcaaguacacuuagcuagggagucaucucuccaacuccuaugaucuuaucugaaguugggauucuacagcuaugccacacuacagagagagugauggcugagaccaaaggguccugcugcuacccaaguaccguucuguggcugugcacccugaugucugcucugcugggauucugcuucaccugucgucggccuggaaaucaguguacagaaauguggccugaugagcaugcaugacccagguaagcaggcccagaaagaaaacacaggaacuacacgccaggcaaaacacuuguguucccacggggggcuaccgagaaggccaagaucaacugcagugcuuuccuggauagcuaaggcugaaggauaccuucauggggguggggggugggguggggggaaauauuccucuuuccaucaagacagaagucuucagaauccuccugagccgcacggaagcauuuaugccauuuucaguagccauacaaaaagcucaagaaauagauuccuucaacacugaguugaggcaagauugcuuaaaaauaaaauaaaauauaaaauaaaauaaaaacucagaaguggccugggacuauauacauuugaaggaucacagggauagcgaagucauuucuaaucuuugccaugugccaaacauacacagaaauacucagaaaguuacucgagcuuaugcuggcaacucccccaccccaaguuuucugucugacuuggggugaggugaaccuggugaaguuccacagggcuccccuuucccuguaacugugauguauccacacauucugggaaacacuggggggagggggaggaggcuaucaguauaaacgacagcacccugaaauuaaaugucagauaacucugcuaauacaccccuccucaaaaucuccagugcgucccaaggcuuaccuaaaugauaaccucuacaucugcaugcaacagugccuccuauaauccuaguacugccuaccucccccaggagcugaacacaagacaggcccaaaugucauucugugcucucuccucuucugucccugugcuuucuagucccccaaacccuuccaggccagcuuugcucagaagccuguguggccuucuccaccagagucuuccuuuugguacccagagcaccuucuguccucuccucuggggcucucugaagccugugcuuugcacuaccuguguucaucugcuuauuacaaaucuuucucuccuuuauuaaauaagugaggaagaagugaaccagcugagcccuaauacuauacaacgagagacaaaggugaguuguugcuauggguggccccucaaagcuuuggauuucaucacaguuaccagagaaagcuacuacuaaagagucucaaauguccuggccagagauauccuugaagcaagaggcucucaaccuguggguuuagauuccuuugaggucaaauaucagacauccuucauaucaugcauuuacauuacaauucauaacaguaguaaaauuacagauaugacguagcaaugaauagauuaugguugggggucaccacuacaugaggaacuguauuaaaggguggcaguacuggaaggcugagaaacacuguuuuuuaacacaagucuccaggccucaccugcccuccacucccuucucaaaugcuaacagcagggcuggcgucagcuuuccagggaagcuuccccaauaccagaauccuuaacaauacuuggcugauauuuauaguagccagaagcuggaaacaaccuagaugucccucaacagaggaauggauacagaaaaugugguacauuuacacaauggaguacuacucagcuauuaaaaacaaugacuucuugaaauuugcaggcaaauggauggaucuagaaaauaucauccugagugagguaacucaagucacaaaagaacagauaugguauggacucacugauaaguggguacuaggcagaaagcauggaauacccacaauacaacucauggaccacaugaagcucaagaggaagaccaaagaguggaugcuucauccuacuuagaagggagaacaauauaaucaagggaaguagagggugggagggauuugggaagaagaaaggagggggaggggaaaagagggugcagagucagguauugaaggagcuagaggagauguacagagggucaggaaauugaacagaggggauggggaacuggagguagcaaccacaaagucccagaugcgaggaaagcaagagccucccaggaccccauggagaugacauuagcugaaauaacccacaaaggggaaggagaaccugucaagaccauauccagagguuagacugccccccacccccguugaaggauggggcaacccacccaucuucaaaguuuuaacucagaauugcuccugucuaaaggaaauacagggacaaagaguggagcagagacugaaggaaaguccauccagagacuguccuaccuggggauccaucucacacgcagacaccaaacccagacacuauuuauugcugaugccaagaagugcuugcugacaggagccugauacagcucccuccugagaggcucugccagauccugaccaauacagaugaagaggcuggcagccaaauaucagacuaagcacagggaccccaauggagaaguuagaggaagaacugaaggagcugaaggggccuuaucuggcaucaaugggaggggaggcccuugguccuguaaaggcuugaugcccuaguguagaggaaugcuagggcagugaggugggacugggugggugggggagcacccgcauagaagcaggguaaggugggaugggauagaggguuugcagaggggaaaccaggaaaaaggauaacauuugaaauguaaacaaauaaaauacucauuuaaaaaaaaaaaagacuuggcugguacuucauaccuaaguuuugaauaaugaaaaaauaggcuauaaauauucuuggaaauaaaaaccagccuucaauuuucagcaacaucuaaguguaugauacuuuuaguuaaggcauaaugauaagauaaucauaccauguaauaauccugauaagaaauaaucaaagccuccuuuugacuuucuaugccuaucgcuugcucaguguggaaaaaaggggugggggagcuuauccuccaguaacuaacagaucugacagcuacuaauccgccaaggaaaacgugcuucccgaugucagggaguauagggcacagaucuacuggggggacauaaugaaacgagauggaguuacaguucacuuuaaaauuuaauacaagcaacaaugaauuaagggugaccacggccucauguacgggaggccccagaaugauugcgacacucugggcaggguaccuggcacaugcagaaggauucgcaaggagaaggagguuuuucugaagcuucucugcucgcaaugggaagauggacggggugagcagcucuguuucuggcuguauguaccaggggaagacccaggccagaguuggugugagaaaaacuggagguuguaaagaaaccucauccagacauaccagccuggggacaagccuucuccggaucuucccgucacugucuuucuaagggcccugauugcuuaguuaauacacguauaaaacuucaaagcauuaacacagagcuacaccagagccguagcaaaugucugaaggggccagcaagggcacacaggccagagucuggaaagaagcugugugcacaugcaguaagcaccagcuuuacucucugcugagaaacccacggcugcuuuaaaacccagcuugcaaagcauuucugugcagaaggcacaaccccuaucaauacuccaaauccugaaagcugaucaauacacagacgcuguaagcuaaucaauguacaagcucugcaagcugaaauaucucuguaauaaaaugaacuguccguacuuugcaauucuuucugcuucucuguuugaaaaggagauggcuugggugucaggugcucaagugcuugcuguacaagagaacccacguaacaugugccugaaaucucagcacuuagaaaguggacacagggacaucucugaggcuugucagccaguuagucuacaaacuggugagcuccacguucauugagagacauacucaaaagauaagauagagaaaaaagacacccugugucuccuugaaccuccagagggugugcacaaauauauacaugcauacaaaugcauucucucucucucucacacacacacacacacacacacacacacacacacacacaccccagagcacaguaggcugaggcagguuaagugucagaugaaucacaauuucccugggaguuaagcaccacaggcaggcugcugucacuccugcaggaaagguucccugggaauaccuuggacugcuagaacucagcgcccuagcuuagacucguguggugguuuggaugagaaaugucacccauggggucacacauuugaacgaacggccccaggaguuggugcuacuuggggaggcuguggaaccucugggaggugcugccuugcuggaggaagugcaccaggagugggcuuuggggguucagggccuuaccucauuuccugucucauguuugcaguuugagaugugagcucuaaccuuuugucuugccugcuuauugccaugccucucccaccguuacggaugcuccccauuauaagcuccuccuucccuaaggcauuuuggucauggugucucaucacggcaacaaaaaguguaacuacuacgauaugcaacccuugaugacugcaccuuaagaaugaagacacccauuugccaaauuguuaguauccugugacaacuccacaggacuuagagcaggaaggugggugaccaccuaggcagcaggagcaggcccaggguuucaccuucauucugcguaacaaacccaaggauauuugaaaaguacacuaaucggggcugggagcuggcucagccccuaaggguaagggcagcugcugucaggugccuacaacgaguggaguugaacccccaggagccacuugacaaaaggagagacugacucccacaaguuguauucugacacacauacacacacacacacacacacacacacacacacacacacacacacacaaacacuauuaagacgcagcacgccacaguucugugaaaggagaauggaguguuuacccuuccagcugcuccucuccuaagaugagacgaagguucuucaggaaggacaaggagaccaaggcaugagaauggcggaucuucacguagccggucaccaccucgaugagccccaugaaguucuccaacuccgaggcaauguuaucuagagaaagaggaguccaugucaccgagucuuccucuggucagguggcgcacuauacucagauucacacacacugguguggaugcgaaggggaagcaggucuugcgugggggaauugcagugagaaggcuggcauagcaccaaccgucccugucuccacucuccgcaagccacaccgggacaaggccucugaggcgggaaagcagacuucuaggaggcuggcugcugcaguugccaagcugauuaacagaacgugaaaucagaaaugccaggcugcuaauuagccccagcugacaaauggaggcaacaucucuuagauaugcucagugacaggcaguccuggcuccacagugccauggcaggacugggcaaaccugucccagccugguaagaauggucuuugcuggaccuggaguuccauauuuaaagacuccauuuagggcugcaggaaaacacuccaauaucacagcaaugaugcaugcagguaguugaucuaucuuuccccacccuggaucgagacaggguuucauguaugcuagacuuaagaugaggcugaacuccugaucuuccugcuuccucucccugaucccuauuccuggccugcaggcaguuuuguuuuguucucucucucucucucucucucucucucucucucucucucucucucuaaauaauuucugcaucucuaaguuuucuauccugcucauaauuacuucuguaaccagaaaguugccaggaaaaguugcuaauguaacaggaccgagagccagugaauuucuuuuaucgugcuuacccaccuuucacauagcaaguaacauaaacuuugguucaugacaaaauucuaagacuauaauaaauuaggugaaugggauuuuuauuauaucugauucuugaagguugauuuggugaaaguuucuccuaugguuugauauaaagaagaggacaaaagccuuauacuaagucugagccucacagaguccccucacuugcaaaauacauacagugcuaguuguauguaagggcuacagggaauucaaccugaaaaaaagaguggcugcggcuaagccuguguuuuguuccccaagaauugaaucuauaaccccugugugcaagacaagugcucuggccgcccugaacucacucuguagaccaggcuagucucgaauucagagaucugccugccucugccucagaagcacuaggaugaaaggugucuucacuguguagaccaggcuagccucgaguucagagaucugccugccucugccucagaagcacuaggaugaaaggugucuucacuguguagaccaggcuagccucgaguucagagaucugccugccucugccucagaagcacuaggaugaaaggugucuucacuguguagaccaggcuagccucaaguucagagaucugccugccucugccucagaagcacuaggaugaaaggugucuucacuguggagaccaggcuagccucaaauucagagaucugccugccucugccucagaagcacuaggaugaaaguugucugucaccacacccaguaaguaauucuucuucaugggcugaauuucccaaucacauugaucucccaugacaggaagauauaaaaacaguaagguuuaugaauuuuaaaaggcaugucuugggaucaauaaacucaaagaaaauuaauagaucugguaugagcaaaacuacaauuugguuauuaacauaagggucagcguucuuguguggggaacagggcccuccauuguggaaggguagagaaugggcaauaaaaacuaaggacuugggggcucgagagauggcucagcaguuaagagcacugacugcucuuccaaagguccugaguucaaaucacagcaacuacaugguggcucacaacuauccauaaugagaucugaugcccuauucuggggugucugaagacagcuacagugcacuuacauauaauaaaucaaucaaucaaucaaucaaucaaucuuaaagaaacaaacaaacaaacagacaaaugcccaagccucaaaaacucacuaccacaaaaaaccccauaaagaaaaaaacaaacaaacaaaaauccaaaaccauacauacaaaaagaaacccuaaaccaaaaaaaaaaaaaaaaaaaacaacaaaaaaacccaccuuguuucuauuaccucuacagacuaagaauauaauucacuuauuuaacaaauacuuaggggcaagcaauccacuauaaauaaagaggacacuuugucucugaaguaaagaaaaacuuucuuucccuaaagauuuaccaguaaagauuaaaauaauagucuucugccuauaguauuuuaccucaugaaacuacuaguagcucaaccuagaaguucuaguggcaggaacugaagggcaucuaucuaggggacuuucucugucaguccaagacuagagaagauaagauuacagggcucugcugccaccaugggagauguuguucaugaauacaauucugaagcaacaucccaggagcgcugucuacaccaagugaagaaagggagucugcaggcucagaccacagcuugagguguggauggcacaucuuucuggcucugagagguaaaacaggagaucacucuuuaaucuuuccuuugcucagucuccucaacggaggcaagcaacccaaacucuggccuuacagaaguguggacucugcagcagcuagcaugagccagccaugggucugagccaucagaggugugugugugugugugugagagagagugugagagggugaguguguguaugugugugugugugagagagagugugagagugugugugugugugagagagugugagagagagagagagagagagagagagagagagagagagagagagagagagagagagagaacaggccuuuccugcguaagaugugacuuaaagaaagacgagggcugauccucuuuacaggaguauauucugggcuaauggcucaaacaucgacugucuuucuaucuggauuuuauguuuccgagaaacucacaggggaggcgucacacaagaggcuuacuuacaucccgugcugcuuuucuaagccuguauucugcuugugacuaaagggacagagccaggaagagcaucgacgcaaguaaaccaagaagcgguccagccacuggucuggugggguggaguacuuacugccucuccggauguuaauaagcagauugcccuucaggauggugcauccuuggagcauuugagcagaagucaccgaaucgaugguuuucguuuucuucucuucaucgccgcagacuuuggggcaggggccuucgcaggggauacaguacaugcuggugaagauaaagaguggaccaaaaccacaaaagugaguuuaucuucuugcauuaaaacaaacaaacaaaaaagaaaacaaaacagaaaaguaaggaggcuuuuuguuuguuauuacagcagcauuucaugaaagaaccaggcugaaacauccaaacaaucacacaguauaaucuccuacccagggcaagccauccaagcugcaaacacacagagggaacacagacugcagaagaggaaagcaugucgcuuguuuuuagacagaauacacuucccaugcaagaagcauguggguaucauaggcuuguggcuggggagccagcuggucuaccugggagacacagacucacaggcacucuggggcucugaauaaauggagcugcucacugaugagacccucgccugccugcaugccagaggagguugggcaagcuggcagcgcuggggaagggacagccgcaucuuugucacuaacaggagucuaauucccaaagcccagggagagauuccaacagguaccuggcgcagugcagguccauuauuuucuugcuaaagcacaagugaauuuauaucuugacagugcuuugcagaaacuuguaaauugauccaaauguuguuuugcugcacauacaauaaaagccaggaaccuccgcagcucucuaaugagguccuuguccgaaugcuacccucagugccacacacaaccuggagccagaagcaguggcaugcuuccugcuuccugcccaucauuuaggaaacggcagagaagaugcuaagccuggggcuauaccuucugagaccuuagccuguauacagaauaagggccgagaagcugggucgauuucugaaugagaaaaaugacccaaucuucuggaaugggugggacaguguuauauucaaauuacugcucuuaaaugaguccgugaaaccucacgaaaagaaagaaaaucaggguaaagcaagagcugccuuuacuaaagucuuccauccguucccaaaauacuaucuauagucuguuuuguuuaaaaaccuuaauaguucucuguuaucuuccuauuuccuauuaggagaguggggcugagguuuucacaggcucccaugggaaguggaccuagcuagccaaagugggggacaucuggcuuccuauaauaccacaugcaacaugcuugugguguuggaacgagaauggccccauagacucaugcauuugaaggcucagucccuagcuaacagaacugcuugggaaggauuaggaggcgucuggugcugagcucucaguuauuuccuucacuccaccaucugggauccugcccuuugaaaucacaagccaaauuagacauacuucuguauacgcagcuaaggucaugacauuuuaucacagcacuagagaagaaacuaagacagcucucauuucuagccuggagagggguuuccuucugaacuuucuuugugcucuguuuguguuuuucucauuuaacuacaugacgcauaaaacccagcucucucuaaaaacaaacaaacaaacaaaaacauacuuggaauaacugcagcuucauacacagacccgugcagacaguacagagcacccguguacuuuccacccaacgcucccaacugcugcuacauccaacauaacgauaacacagugaccuggcacgcgugucagguucugugcauuucuccaucugucuacauagaccuguaaauucccuacugcaaucgaguucgaggacaacuucaacaaaguccuccuguguguugccuguuuguagcugcccucugaccugccccagacuucacuaucccuaacucccgguaacugccaaggugucuucuacugccaccuugggaaauguuacagaaaggcagucauauagcacauggcuucugaggcugaugugcuucccaauguacaacacccuugaaguuaaaccuuccuuuaccucuccuggugauguucuguggggaggccugcuuuccuacuuauuguaccagauaucugaguuguccucacuuccugguauuacaaacaaagaggcuacagacaaguacaugaaauaaacguucagggucaacaugacuauguuuauucuuuccccauuuuuuuuuuauccaaauaggaaaaccuggagccaccucccgcuuuguuaaaaugucuaggaaucauuuagcaauugaaaacaugucuauaaggguguguucugauuauagcuuaaguuuccuaaaacccacucuuguauagacagagcacaaacaguauuuucaaaauacuuucaagcaagugcuaaauaggcuucaaaggccagcagagggacagcuauuauuucuugauaguauuuuaauuuaaaaugggagagacugugagaacgggcagggagcagcagcccagugcuuuaagagcacacuggagggaaggagacccaacuccuaugaagacacagcauccucacuguguguuacaggacaguugaaugccuuucaguagggagaggaaauaaacuugcaggucaaauaugauauagugaguuugauggccagcucucccucuuuuuuuuuuuuaauuuuuauuagguauuuuccucauuuacauuuccaaugcuaucucaaaagucccccauacccacccccccacuccccuauucacccacucccccuuuuuggcccuggcguuccccuguacuggggcauauaaaguuugcaaguccaaugggccucucuuuccagugauggccgacuaggccaucuuuugauacauaugcagcuagagucaagagcuccgggguacugguuaguucauaauguuguuccaccuauaggguugcagaccccuuaagcuccuuggguauuuucucuagcuccuccauugggggcccugugauccauccaacagcugacucugagcauccacuucuguguuugcuaggccccuggcauagucucacaagagaccagcucucccucuuaccagccagcucucccuugcugcucccagccccagaaggaaggcauugucuggacuguggguaagcaacuucacacugccagacaaaggucuuuggcucaagauguagagggguacauacaccccuuuucuaugcuaaaagugauuauuuagauguaaagggccucuaaaggcuuaucuaguaacagcuuagucaacagcucaacaagguaggguuuacuagaaggccugucuguccuuggcacaugccaaaagcaauggacccaagagcuaaaaccaaccuccccccuccucuucuucauccuccuccuccuccucuuccucuucuucauaaacugaucacccuaaguauuuuguuacaguaaccgagaguugacuaacagagacugccaacacaugaauaaaaaaauggcagacuuauuuuuaguagacuguauuauacaauucugagucauuguagucccuggcuuaccaaaucauuuaaaaauauuugaucuuuuccuuuuuacugugauaauggugcagaaauuaaacagguaggaauuuacuuuucaucuuaguauuaugaaagaaaauguaaucuuugguuugauccagcagucagcuuacaguuagagacaucuccaaauacuauagcagcaauggaauuucuuuuugaagauguacugaacaucuuuuauagagagugacuguagcaaaacuauacauuuuauauacuuacagaauuguuagcaaugcuggagacuggaccuagguccuucuaugugccagagauuggaucuaggaccuucuacaagguggggacuggauccagggcaucucacaagugugggcaguauucagaacuuccuaguuguauuuucagaggcucagaaauguguauguguguacaguaccggaggcagggaaugaauuacaauggaaccuucccccaaaguccucugcucuguucaggggaggaaacaacaaccucagaccucugacuguccuguguuuccagaguuauaaaauccugucuucacgaacaucacccaugacgaguuuguggaaguacagcuuguucagucagaaacagcucugcuuccacagugaagccucagaguccaggaaggaaaaccagaggccacaaagaugguggaaggcuuagagaaaggagguucuggcagaaaacauggcagaucagacuacuaguucaugcccagagcccaggcuugcaaugagacaugggagaccuguuuccaggccucaugaaugcuggugaggguugucuucacucucucucagacugagaggcaaagcuuucacuggccuagaguagcaagcugggaaggaguaucuguaguuaaagucuccaccgcucaugcuucagcuuugcaggugcacggggagcaaggcucgggagcaccuggccagcaagcuaauucuuacgcucuagugcuagcaaggcacccucaaaguuuagaaauaaaaaagcaagcugaaacagacccaccacuccaagauucgcauuaaaacaagcucagccaucacccucugacagacccaucugggugaaccccugggagguccuacacuuaggggcuaugcagcagagaacccuccugggccuagggacaagagccgcugaccucugggugcuguugcggaugaagccugagggacacuccugcaugcacucaucgucguggauaacgaagccauccgagucacugcucucagcguuggggauguuggcgcagaaaucgcgauccacacagcgccagcccucgaaccuguaggugccaggcgggcaggcaggcacacacacgccuuuguaguaguagugucugcaggccacgcagguuguguugucguccgguguguggcagcugcccaggcacuccggguggcagcacucguuguucucggugcaggcucgcuucccgcacacacuugggcacacugugaggacagagggagagagggugguaaggaugaugggcuacacagccuccccugggucauccgcugccaccaccagcguggcguaccggagacuggcuagaaaagcacaccuccucugaaaucugcguagaucuuaccgucugugaauuccacuuggguaaagacacaacccaacccaaguccauucucuccuuuagacuccugguuugcuaugggaugagccauuaacauuuaacacccauggacucuucaaaaugcaguggccacacccauuaaaagggagcccaugguacuggugaacagagagaaauacagacaauaugggccucuaggacuauacaaggcacugugcuccucagcucuccuucuguaugagaauuccauucuaagaccccaguggaugccugaaccacgcacagaacacuggccugugcacacccccuucucccucaugcauacaaagugaugaagagaggaggcauaacaaguacggugguuugaaggagaaauguccuacacagguucauggaugugaacaccaggccgguggugguggucuguuugggaagguuacagagccuuuagcagggagcuggaggaaguccuuugcuggggguagaguuuguuugggguuuuacagccuggcccacuucucuauuuccuguguguggguggaaugcgaucacuuuguguuuccugccugacaagacuaaagccauuccuuccccccuccccccggccaccacaaggacucuguccccucuaggacuguacaccaagauaaaccucuaucucuggcuccauuuuucugucaagguauuuuaucacagcaacaggaaaguuccaaauaaaacagggaacuagucaaaaccucuagguuacugcagcaaauguuaaccauacccuuuacaaaagcacugcgugacuguggccucucucuucucaaacuccagaaaaagaaauccaggcuacggagggacuacucuuugccaugggcacagaaguaauuauggucucuaaagaggaacaagcuacaaucgaagugcccagugcuuauagaaggucuuugguaaugcccgcaucugcaacgucucuucacaacacaaccuucagaucacaagcaagcugcuggacgguacaggaugguaguacacaggguuucuguacccaggggccaccugcuauaagccuuguuaaguuaaaggccagguccaguaaucacagaucuaaaaucacacccugaacagguacucugcuaugcacuucuguaaauaugucaugaugaacacacgccuaugauccuuacuugugaacaacauauaaaacaaacaaacaaacaaacaaacaaacaaaucuggcuaacaguacauguacccaauugggggaagggauuguuuggaaauacuacagaacuacauaaauauguauauuuuaacugugauguaccaaagagucaagauuccauguuuuauuaaaaaaaaaaaaaacuacucuaaaaccaaaacuaagccaaauaagccccaguaaccacagguuaacauaaagaacacacaaguucaucugcacccaaaacagccgcuuugucaacccuucaugacguggucuuucccggguucuuccugugcacagguguaugacuacacauaccugaauguuaaaccuuggacuacggagaaagcacuggauagacuuggaguggauaccaccauacagcaaucucgcuacgucucaccguuacagcugugccccagcaucaaacgcgcccuccaugcccacacauuacuguuccaugaguacggccaucuuugugggcaccucugcacgccacugggaucaguuuucagaacugacugcacggagucaguaugugcucuggagccuuacaccagucugucuacacagcucuaagucacauccaagaauuccugugucacugcccuuaaaaacaguuaaaucagcagcaugacccaguaaggagaccggaguucucgugacacugccaaaucgacauaaucuugcauuugacucuaaagucaucccuccacagaaacaucggggcauuuccccucccugguuaucucccccuguaggaguuuuagguguucugcuggguaugcucuuuggcuccaaggccuccuagccuccacuguggcuagagcguggcugcucuguguuugaaguucguucaucccaugggcuauaaagcaaaaguuuuacuagagcuuccuggaacacuccuuuaaaaauacagugugugucuccuuuuuucuugcuggcugaaacauagaaaugaugcacagauauucacgcagccaucucagauggaacaugaggcaacauagugaguucaacuuggccucucaagauggcuggugucucuagaccagugguucucagccugugggucgugauccucuugaggggugacauaucagacaccauggguaucagauacguacauuaugauucauaauaguaccaaaguuauaauuaugaaguagcaacaaaauaauuuuaugguuggggucaccacaacauaaggaacuguauuaaauagucacagcaugaagaaggcugaaaccacugcucuagacuaacacugcagcugcugaccuuugaacuucuucaggugaagagaaaccaacuuuuaucuaugcaacugaaccauccacacagaagaccuaucuucagagccacacacaagugaagacggaaagccuucucagcugguuuaugaccuucauuuauuauaacuagcuucaggcuguuuuuggacacccauucuagcucaggaacaagcagaaguuaauuaucucuggucacaccaaaaaacaaacaaacaaacaaacaaaaaacauaaaacaacaacaaaaacaccaaaaaucaaaccaaacaaacaaaaaccugcaggagccccuaauaucagaauucagacacugucuaccacagcaauuaccucaaagacaguaaaauggaguucacugauuuaacagccuaccauguuuuuagcuucacacacuaccacugauucuuuuuucacucaaacacaucaauauaugacacaguugaagaugauagucugaugacuuaauuaaacauaugcacugcacggguuacaucaagguuuggggucuaaaugagcacugaaguuauuuguguuaauuuuuuuuuuuuuaaaucugucaaugacagaagucaacgaucuguuggcauuuacguacccacccagaauuuacuggauaaacgcugcaccugugugccaggcaacuggacauccuguacaauuguacgguggcagucccugaccucaaggaaaggauaccacaccagggaagcaggaaagaccacgcacaggguguuccuaguacuguggguuccuggaagggucuucagagacagugagauuggcacugaaaaaggaaggccgauggggaggggcaucaggaccacccgucacagagguccucagauguaaauacaggcugagauguugcuggaaacaaaauggaccagcucagggagguaccacaggcacaccgauugacggacagcaggaaaucacccugcuuuaggcaaggguuagguucucacacuagaaaggucagcaugcuguauagcgaaggcaugauaaccagagugggcagaagggcagaagaacagccagaggagaggaaucugcuacugauuacacuguccaucuauggcucacacagauacauaaaguucaauguaacucgcuaaaggcucccuggugcagcugucccagccauccgccaacaccauugcucugugauucguuagcucgacguuaucagcagagauuaucaaugaggacuagaugccaacuuuggagcccuuuacuuacuuacauaggaaagaaaaugauacaucacaauagaugaugaagucaaauagcuacauaguagucaaagcccauaccauauaaaagcagggggaaauaaccuuguacacugucuugaaucaguuaccccccaaaugcaaaugcuacaucuuuccaggaugagaaagagaaauagaaauccuugacaaaggauuugcuaaauuugagacauguugagcccuguuccaggccugugaugggaacuucuucucaacuaagaaccauaaaguuaaaaacacugucuuuacagauagaacgguucuuuuaaggcauauaccagauccaugagucccuuaacacucagugaugccaacugugaacaaaugcgcaucugauauucuguggguggaagaggacaaaaaagggguaugcagagagggagagagaagauggaggaaggccgaccugcuugcuaggggacugacucuagagaucuguguguggcuacagggaggaaagggguguggcucucucuccagcacagaggauuccaggaggaagcaggagaacgcagggcugggauuagacaguccuggagccagcuucagaagccugcuguaaauuuugucucaucucgauguauauaaauauuauuaguguucaggacuauuaagggauuucuugaaaagccccgggcagugcgucucgccagcagauggauggcugcucuccaugagugccaaaacuuaaaauuuagugcaguaaccaaauuuccaauuacagcaccauggggggaaaggaggggaccucccccgccacuccagaggaggggcacacaggcaugguuaaagggcaguccaaccuuaaaaagaggaaacggaagcugugaacuagggcacgaaggaaagcaaauugauuuugcccaugagaccguucuauuccuugccauuaaucagcgaagacaauaaaaacaaaaccuuauugaaacagucagaaaagcuacaacauguccugugucagccaucagaaggacagguccagggucagcgugcauacggaggccacacguuuuaaaacuccucuucauuucuuuaagagaggacaaacaagccucgcacaucagcuugguccuugcauuuaguaaguucuuucuaauuucccuuuagcccgugauugcuucugucagugaauccuuucaugaucgaaagcuccgagaagcgagcaagcuaaagcuuccgaguccaacgugggaagaagaaguaacgagaccgcagaagagaaggauggaagcauuagacaaggcaguggaaaacacuggugggaacacagaggccagugagggaagggggagguaacaggugcucugggugacugucagagcccauggggaguaagguuccgaacaucguauucaacuguaguccaaacucuagaacagaguuaaaaagccauuugcuaucaguccguaagucucucuggcaagaaucuucauauuauuugaaacaccacaccuaggauuuccaugggcuuccccaguucgaaacuaagccaacaagaccugucuucaggcucuaguggccuaccuccaaaggaaccuuucucauuucauuaacccaaccaagcacucuauggaggaguguguggauaagccuugaaauagacucguggcuaaucuugggagcauccugcccaguacuuaaacaugcagaagccuccuccguccugccccuccucuucuuuuucuuuccuccuccuccuccuguuucuccugcuccugcuccuccuccugcuccugcuccuccuccuccuccugcuccuccuccuccugcuccuccuccuccugcugcuccuccuccugcugcuccuccuccuccuccuccuccucaauuuggcccuuuccaaggcaagaggacauguaauacucagggccgucacauguauuuguuuauaaagauuuauacauucuacuuuauguguguguguauguaccacuuuuacgucugguacccagagguuagaagaggaugucagauuucugggaaacuggaguuacagaugauugugaaacauuauguuugcgcugggaaccuaaccuggguccccuguaagagcaacacgugugaauaaccacugagccaccuccccgguuuccugauaauguacuuguaagacuuuccagacacaaccaugguaccaggagcccaagggcagaguaucaccaaggcuggccaugccuucuguuuuguccucagguuaaccagcaaggaggaugcucaugaugcucccaugccuugcuaccuuucaggaaaggcaaagauaggccagggaacucaggacuccucauaguuuggauggaaguuccaguuuucaaagaaugaguaucucuguuggcaggaacugugccugacugaggaggagcaggggaccaauggcaagaacaaggagaaaaagcccagcugggggucugugcuguguccaccuuacaagcaucacaaugcuuucaguuuauuagucuucaauguaccccuccacuaucucucuucacauaccuuuccccacuccaaucuccucauauaaagguacuacuaugacuucacuguaccucugaaacaaaaauuacauguugcaauuugacuauugucauuaugguguggugguaagacuaacuaaaucuaaccaaaccaaaucuaaucuauguuggagguaaggccuuugggagagaauuaggauuguauggugucacuagggugggacaucauugugguaguagugccuuuaucuuauauauagagagagacagagacagagacagacagagcaagcaggcaagcucagcaagucaugccuuggccaugccauaaugcaauaggaaugcccuccuuagagacugacacuacauccuuggacuucucugucuccagaacuaugaaaaaguauuuucuuuauaaacuaaccagcaucagguaagauaaguauaccucauaaggaauagauggugaguguugcuucuuggacucagucagucacuggguuacauccuagcaaaaucuguggcucaacucacaaagucaaacuaaauagugcuucucccccccgccccccccccccagggggagggaucgagggugggagagucagagacagaguaagaaugaggagaaaggagaaugcuuucuccaaaaggaagacaaggaccuaaaacauacuuauggucuuugcaacgucaaaaggagaacucuacugccucacuacugagcaagcauccagaguuuaaaacagugucuaagcaugucugccuggaagacuguagccacugcauagucugucacacagcaaaggcaacuucacguggcaaacagugucuuaaaagcccaggccgaaaaaucacauugguaaaaguauucucugccuaaugccaaaaaccaaaccaaaccacaccauaccaaaccaauccgaaccaaacgaaagcaaucuccuuuuguggcggggcgguaggcagauccagaggagacgucauuuuaagccagaauccaaagcuauuucaguuucuguuugaacagaaaggcuguuacagauggagaacuuccacagagaaaagcggacccugagcagaacacuccuggagcacagcaagcuggacagagagaggacaggaccgcgugcuuuuuugaccuguuggcacgcuagucaugagagcuccuaacuuuuccagcagcugaugcuguaagucauuuucuccuuauugacuuucaaaggauuuucaacugcucuggguuagcuugcuuccuaagaagagcccugaacagugcacccgcacuugggcaguuucuugauucuuggggaguauauaaagggcuauaagucacauauuguugcuccccuuuggcuuugcccuuugcuuuccacaccuugaaaguugcagggcugcucugcaggcagcaugguccagucacagacggccagagucacaggcagguccccaucuuaauuccaaauacaucugcaaaaccccuagacagucuuccaagcagcccaagggaagcccacuguuugcaggcggugccccucaaugcggagacagcacucauuuggaucugguuucccaggugaccuuccggcagcauucacuccucagggcuccaugaaggucuggcacaugcggggcaaggcugcucucucccacaugcuugcaacccuauucuaacagcacaggaucauuugaaucaguguggaauaugcugagacugaaagauguggucugccacggcuaggguaacuugcucagacucagaucucaaaaguaaggacaugcccacacucugcaggcucauucugagccucuaaucacugagaucucccaggucagccuuuccacaauagcugucugagucucucuuauauaaauccaauuuauaccacaaaggcaaaauacaaggcugcuuauuaauacggaguuaacuuucaguguuauuucccauaugccugaugacacuuuagguguguuacuuauaugcauuauuuaauccuccugauaaucacaaaggguaggcauccuucacuuagagauggacaaacuggagacaucggagagauuaaagaacucaugcaagaggaucaggcugcugugccguuguugggugucacacucagaguccccaacagaugacagcagccucuccacacaucuucccaucgugguguggacggcuucugagccucucugcugucugaaaggcaugcugcaggggaguugcuugcaugcuaguuuucuuuuuaagcaugcaaccauaaggaagaaauaaaccaaaagcccuacuacccuuuucuacucucuugagguauaucccuaaaucuagaggacaaaacaaaguaacauacacaccgaagagccccgccucgugcauacaagugauacuagagaaauaauauguaucaacucaguguccucuauugaguuguagccaauggaagucucauggacauuuuucugccacaaauuuaaaagacuagauuuuuuuuuuuuuucaugagacaggguuucucuguauagccuugguuguuuuggaacucgauccacagaccaggcuggccuugaacuuagggauccaccugccuccauuuucagaguguuaugauuaaagauguggaccacccugccuggccgccaggcuggaucuuguugguaucucuaagagccacugcaaaguugcacacuaacagagaagcuucucuucugaaagaugcacagucaacauggcuuaccugauaggaaaugacugugacaucagaccaaccagaccaacaagacccaaaagacuacaggcuccucagagucagcucggaccaaauaagucgacugaaugcaguaagcaugcuuagguuuucaaaugcccugagacaauacucugagaggugaucauagcauccuuccaggaaccuugcuaggucacaacucaugccucacucaagagcugcuccuucccaagcuuguaaacccacucuaacagcacagaggcauucucuuuagcaagccauacaguucuguaagauggaaacuuugucguggaagaaaaucugagucagggccaguugagauggcucaguggguagauaaaacagcuauccuucugauggccuguucgacccccaccccccucacccuggaagucacauggaggagggacagaaucaauuccuaccaaguguuuucugacugccacauacaugcugugguguagguaggagucuccucccccaauaauguuucuaaguuggggaacaguucagugcguccuccuuuugggagagcacaguuugaaggcucggagaaaauaaccgaguagcaucgcacaguccaggacagaagguaagccacagaguucagcugcugaagcaucugggaacauuucauuaaugagcaaaagaaacaaucgccuacugacaaugccugugggaucacugaggccucgggaaccaagcagugcugggcagaguacugagaaaacaggaaaacaaacacugcaaaagggguaacaaagaagccugcggagggaaguuauaaauagcaacauuauaacuagaaagcugcguggaaagagugaggaccgaggugcagcugacccaaagagggagagcaggaaauuucaauaaaugacaaaggccggcagaacagagagggcucugcccacggugggcuaagaguuuccuuucuucuuccugcacauuuuguaauaucagcuuuacaaacacacacacacacacacacacacacacacuuaaaaaagcagaaagucuggugguuuucagugucuucguagaguugugcaaauacugccacaaucgacguuagaauauuuucaucaucccaaagcaaaaagcccauacauagcaaagcuucccccagcucuggggaaugacuaaucuuacucgucuccacuucuccacugaaucgccugccaggagcauuuuacuuaguggaaucaaacaaaggguguucuccuguagccacugucuuccauuuaaaacaaugcuuucaauauucacccuuggcauggugucuacuaguccuucuggcuuugggcuguacugauucucacugugggaaagcgagccuuucuauuaauguggagugauaacaucguagguauugggaguagaaaugcuagaaacacugacaaacucggaagggguaaggaugucaaaggaugguggaugcugagguccaggcaaggugcugagaagggucuguuugcaucccagacucuguauuuuuggcuaacucuauccacuaacuugggccauucuuugauagacagggcugucacagugggcauaaucuguagaggaauugucaccuacaguguggacugugucuccccucugcucagcaagcuaccugugccacuuauggaaaaccaagugcacacacaugagcuugagcucuguagaaaugccugacaaauggauggcugaagcugcaacacugaagcucugcuaagauggggagagagaaaaggaagggcaggagagagucaauggaaaagauggugacgaagggugcagcucaaccuuagaguccuuuuaccagcacuauauuguucucacagacugucuuaauucccguguacuuuuaaauagucgaaaacgcgauuuucaaccuauuuuaaaacccacauacaaauuugaaaaacugcaggcagauuuuaacacaggggagaaaacaaacaaagagagcuggcaugggggucaggacagacagggcccucaagcugauggggcauggucagcaggggagggcagcuucauggcugcuucaaggauggagaaucucugucucacaaaagucacacacuuuguccucaagaguucugaaaaaaggaaaagaagcaagaagucccugcagagggccgacuccccugcagccguucucagcaggcuugagcacauaaagaucacuugugacugccugucacagaugcucaaauggacaggauggggaaaaaaaauacccuucacacacuuaaaaauuacucuaaguuauuuuaaaucuggaacuguuuguauauuccuuauaaguuuaugaaacucacacggucgcuccaugacuaacugaagcggaauugagagaguagucucuauuuauaacuucucugcuugugcgugcguccagcccuauuuccauucucugguacuguacgcagaguuaugugaagccgugugggcucugaaaugcuacuuacuuccuaacaaggcaggccuguguuccauaggggcaaaucagugggagacggggugagggguugcaaugaccaagugaaggccaggcucagaggggaggucucaagcacccaucauugcucaggcagaucuuuugcuguugguuuuguuuguuugcuuuauuuuauuuauuuauuuuaaagacagaguugcuuuguaaacccuggcuguccugggacuuccucuguagaccaggcuagccucaaauucacagagauccauuugccucucugccuaccgaguguuuauaccaccuccacccggcuagacugcaccucucuaaacggguguuugagccuguuuugggacaaucgcacaccuggugauggcugagagaucuguucugauggugugaauucaucaauacacacauucccaggucagugccuuaaaucugugugcccgcucaugucaccucuuccacuugauuuuaguggaauugugucaccaaagggugcaaggcuuuaacaggucaugcauaagccucucuccauacacaaauguuuaugugaagauaacugaaaugacugaccagagucacccaugggacaacuaguacucagagcagagcacaugaggccuaggauuaaguucuguuacgaaaagcaagacgguucauggagagaguaauaaaugugaaagauacacgcgcacauagacuacccauggaauucggauggcuacauguacauggacacgaauccccuauucacagcugcucccaucaacuguaagaacagcugcucuaaggcugccuagucauaguuuggaagaaaaaaaucaaaaccaacuccuggaaucuucucuaaaacaaugcucuggugacuguaguugucucgcuucaugcugcuccaagaggaggaacuccccaugaaaaggaggaaaaggcaguccacaguccacgcuuccuuuuugggaaagaucagaagggguaacaggcaccucacaccucaauccugugacuaauuaugaaggugguuuauuuuuacugcauagccuuuucuuuuccaguuuauaucaccucuuaaugucuccagauucauuccuuucuagaaucuuaaacuucauuacagccaucucuuauguccauguaugaaauaaauuaccacuaaaaacaucccugagaaacaugucuaaggcaacucagucacuguaugcacacagugaaguuuacaggaacuaggaggacugugacaucauuauagccccgaccugaacaggaucacugaugugacugaaccuccaggaugcacagcugcguuuaaaucagucgcaguucuugaagaagcacgcacuuucuaaacacagcacggauaucaacagcuggucaagugaccuucagccugcuccucugaggccccugccucucugcucaccacuuccuucauccugcugcucugcuccuguaacuuggcuggaaacaugacuuagguauucccaggaccauccuacuacauacuuuuacuuaccaaguagcaaucauuaaaaaaaaaaaaaaagcucagcuagaccuuuaaauuaucuaggaggguagaaaagcauugucccugauaauuguacauccugaaaaauacuaucacuagcauaaauacauggaauauucauaaucagccuaucucacuguuaaaaaguaccuagaaaagagaccaugcaacuguugagauaccauuucuagaaucucucucuuuuucugagugugcaugugcgcacacacagacuucuguuggcuuucauuguacuuugcuugaauuuugugagcagaggggguggaaaaagguaccaacuuggcuaaaacgcaucgcaaguguugaugccccauagugccaauaggaauccgaguauucuggaaaugaucacuucucaguuucaaccagguuuuuucguuuuguuuuuaaaaaugguacugcccaccguuaaaaaguucacugaaggcauucaaaguucgagaugccacgcucuuuuuuaaaaccauuuuuuaaaacgauuaauaguugagcacuuaggugggcagcgguggcaugcaccuacaauugcagcacuugggaggcagaggcagguggaucuaugugagcuugaggccagccuagucuacagaucaaguuccaggacagagguacauagagaaaaauaaacaaacacaaaaauaaaaccaaaaucaaaaccaccacaacaacaacuacaaaauuggguccagacugggagccauccuaggcacaguggguagaacgcacgccagcugacugaacaguucggaugaagaugccaacagagagaggccccuucuguuuuuuccaauuaauuaggaacuguaugucuguaaauuuuuauuuggucuuugaacuauuaucuccugaucucagauaaucugguuuacucuaaggugcuguccaaaucaucaaguguuccuugauugcucagaccuauccauuaucacccuuggauguaagagacugaagcaaugagaagcauccuggaccucugaagacgagggugaacccaggguauccuuucagacacuguguacagggcaccugcauaguccugugaugucaccugaccccacggggcugggagcagggaaggucauacagagggagggagauacagguagcuuucugcuuccuucccguuugaaccuuuagcccaggucucccuucaucaccuccagacauguucuggaauacccucuaggcugguuuucuacgguucacgggaauuuucauuggaagcugaaggaauuaacagguagauuaacuaucucuauaaaccugaaccccaguaagcagacagugccagcccguaaagcauagaugagucuggaacuuggaaugguguucaagaaucacuuuauccgugguauaaaaauggaagcauucagaaaugggaaagggccaaacugcacuccgccuccuacaacgggaccugugaccccacagaaguuuggcaaugucaaggacacgcgaaguuuaguugcuacacaaagggacuggugccuauacagcgaugccuaagauacaggaccauauuuuccaaaucaacuuaaaugugcaggugugugugugcacauguagugcacguggaagacaaaagggcaaugcaguaugcuuuccacuauugcucucugccuggucuugugaagcaggggcucucacugaagcaggagcuuacugacuggccaagcugguaaccagcaggccuuuucuguuuccuaaggccacuuaguuuuuacacggaugccggggaucugaacucagcuucucacacuugcagaaccaucucuccauuccuccaaaucaacuuuuaagcagagaagccuuaaaugcugcgaacucccaaacuaucagagucuuccucuucuaagaaaguauccccagguuuuccaaauucuggacucagucugaaagcgagggucugaaaaagccagagucaucucuuccacucgggggugagguggaggugggggcaauaagcacuguagcaacuuccuugacauucaugucaaaggagcugcugccuuucuucagaccccagaguuuccucauccagcaggaggaggcagggaggucagggugcagaagccguggagccuguauccuagucugcagcguaugucaaggugugcuuugucccgauuuagagacagagcgagcguugaagugaaaaaggguuaagaggauggaacaaacagaacauacuuugcaggcaaugacagugacccagguaaaggcagaagcugugcucaacucccuguaaugggagccagacaugcaacuucuguuaugcaaugcuuugugaaaaggggaaggcuuuugguggucuccacucucccacgggggccucucucccacggccuaggaacgcaggagagaggaggaauggccaccacaagucugggcugcauuccucuguucugcuucuccauggggccugggagcgagcaccuuugcaagagaaaacuccccaagagcuacuggauucuggagcaaaggcaacucaggaacuaugaacccagaggacggacaucuucacuuggcagauggagaaagugaaguucaagcaaucuaagcgaggaagguuguagugcucgcucacucacuggagggggguuggggggagcuuguucaagcuuccaaggagugaacacagggauugggacaccagaaaagcagcuuuucuucaucuuugaaaucacaagcccuuugaacacacgaaccgcacaccuuccuuaaagaaauacuggggauuuugaaaucaauuuaagcaccucuaauuuccaacccugaaacguuuuacuacgugcauucucuaacugcacucgucucucaccuuguaaacaagcaagaucggcuggaugaguguccccuaauuacgguuuccuuggugcccgucuauccgcauuggcagcaccugaacuuucuccugcacuguaucuuccuaaauugacauucucagcccacacuggcacgcuggccuggugccauucaacagcacaaaugacacaucccaagccugauacuuccguccuccugcccucuccacacugcguguccguaauccugcccuccacccacuccccaacccuuugaaauuucuaaaccccagcagaggaagcccuguagggcucuuaauaagcucagucaugcucgaaauauccguuuuacccacaggguauuguaggcagcaauuccgaccagagcacaucucggcacgagaucauggccuccaaagcccagcguucagaacuccuaagagcaccgcucucaugcagucccacuggaacacuugggaacuucaaacaguuugggggugggaaaaaaacauccucucugauacuuccaccuuccaccuacacuguggguuaggaaacuccuuccuguugcuguggccacggaggguacauaucgcaacucuccuggcucuaguguuugugaaacccacaggaacucugccaccaccuacacagaaagucccaugccagagacaacgacgcauaaacauuuuauguuaaguuagccacaugcuaagaaaauaucaucuugaucagguauuuuucuaguucugucucacguucaagucucaaggcccacguggaggggagcacggaaguacacugguugcauaucuucugccccacuggaagaugcuugggauuucugaagaaaccaccuguaaaucagucuaucccuuagguaaucgagaaagagaguccaugaauuguguuucauugaugugaguccuauaggugcuuccccuuggacaaggauagguaccaagaacaccauccugggcuggggagauggcucaguagguaaagugccugguguuccacaaacauagggccugcguuugguuuccuagcagccaaauaaagcacaggacuuggcaacaggacccugggaucucccuggcuagacgcccucguugaaauagcaaccucuggguucagggagauguuguaguaaagauaauagugauaaucaagguggagauggcuagaggaugauggucgacacccaccgucaacuguggccuucaccugugcacaugcacacacaggcagcaagugcaccccauauacuacacacacaggcagaaagugcaccccauauacuacacauacaggcagaaagcgcaccccauauacuacacacauaggcagcaagugcaccccauauacuacacacacaggcagcaagcgcaccccauauacuacacacacaggcagcaagcacaccccauauacuacacacauaggcagcaagcgcacccacauauacauauacacaguuuuugaaaaaaaaaaaaaagcucaaaucaauuuauaaaacauuaaguuuuaaguuggcccuuaacucacuaauauuauuugagaggaucaucagugaaauuagaaacagaaagaauuuaauuggaaccuguugauguguuucagguuauucaauaacaaaaacaaucugccagcccgguaacauggucauuugcuuugaaugggauugcuucauucuguggauccacauucccugaggugggcccugaauggcuaggcucaucuucugggaagagggacacaauggcacgggguagcauuccucugcacauuaaucaugccaaauaucauuaaaaaacaaaacaaaacaaaaaaccaaaaccuaccagcccggaagccaugguggcagcaguuaaagcaacaacuuaagaacagacgaggcccaucugcaugccgcuguggccacauuugaaaaggcccaaggaaugucugucugucugucuucucugccuacaguuuucaaaauugguuucggggagagugagguucaugcucuguguuagaaacauauuaccgagcagcugucugguuacagaagaacacgggcuugggagaaguucacaguccagcccugucagcugcuguaagucaaagggacucugccuccucagaguuccaccggaggcagaugacagacaccaccccgcacuguuagcccaugaacacacgcagcaaggcacacagcgacagcaagugucuccugcacaucggcagugcucugucaauaucagcugcugucuccacguaagucucuggacuggauucucaccuuggcuuugccaacuauguaacagugcaacuaacuggugcacagguauagaagagaugaggaggcuccuaggaccuuccgccacggcacgcuuggaaaaggaacgugacgaagagcuucuaguuaguucccuucaugugcugaagagcugcagaucugguuucauggaaggaugguuagaugaauaagaaagaaaaagagaacuaaagaauguuuucaauuuuaaaaauuaugugaaauugugugugugugcguguguguguguguguguguaugcaugugugcacaggccaagguguacacaugaagggcagaggugugugugagaguaugugugugugugugugugugugugugugcacaggccaugguauaccagugaaaggcagaggguaagugugggagucacuuucucuagccuuuaccugcuaagccucuuacuggcccguaagggcaggaaucugaaguacuuaaaccucacuucugaucaaauaaaacuuuuauaaacuuuaaaagaccguuuucuuaauuucaguacucuucucagacccuucuguccuagaguaaccucugugugauccacaauagaccugggcucacccagaacucccugaagguucaauggugauggugguuugguuuugugcaguucuaggaauguacagagacacaggcugaccacugaggucauguggggauuaacacuucaucagguacaggagcuguagcucaggggcagugugcuugccuagcaugcuugcagcccugguuccaacccccaggaacgcuaaaacagagaaaacacguaaauaacaugucugccagguagcaagcuauuccaagacaaggaaggagacuucuguguuucgaaaaaucuguuuugaaacacaaagagagacugggacuguggcucaguuaguguagugcuuaucucuauccgagaaguccuggguucaauucccagcaccguuuaaauggggcaugguaauagaggccucuaaucccagucccuggagauaguggcagggggacuccaaguucaaaguuacuccuggcuauauagugaagaaugcaaggcagacuagacugggcuacaugagacucuguuuuaaaaagggaggaagaauccuuccaauacauaacuuuacucaacuuugcuucagcuuacauuauaaacgcugguguuagcauagauacagaagcucuuuccuguguggugaugaaucauuacucacaaccaaaccaagugaggaagcagggccccuuaauauuaauuacgggauucagacagagguaguuagagaacuguauaaugguaacacccaaaacuggguugaguaccccaaauacucaaaagaaacagacaaugcuaaccugggagauuagaaaugauucugcaacuaguucccugcugcaugugcagcuggaggcccccacaaguuggaggcuuggugggagacugagaaagcauuugcuauucguuuucuagguccaaggcauuucuuccaggauccaugggcuggacuagauggagcaagugcaggcuuaagaagcacagguacuguccacacacuccugaucaucaagauggggaggguauccagcuuguuggcuggucacuagaacauccaguucuccuuccauuuguaccacuacuaucuaggacucacugaucuucagucacaggaaaaggucaucuauagccaguggccagagauagccuuuuaugcuugcugcacgacacagucagggcaguauuccaggaaugcacagacagccugcucagcuucucucacuuccccucucauagcccagaucgaggaagauggauucacccauccugucaacaaagacugccagaaucuccuguaguugcagguauacaauugugaguugcuauuuagguuauggaagggcuguggcaugccaacagauaauguguggcuacauggagguaggcaugggaaggggcaaauacacacacacacauaugcacacacacaaacggaacacauacauagacacgcacacacacauaaacacaaacaugcacaaaggcucacacacacacauacacacucacacacauaaacacaaacacacacgugcucacauauacacacacaugcauguacacacacucaugcauacacaaacacacauaaacacacacauauauacccuacuucuguacauguguaguccugacucaggaccuugggaccugcugcucauucagcauaugccgcuuucuguucuccacagacauccugcagaugucccagugaccugccugccgccugccuucccugucuuugagguggugacaacuccugccaccccaacauuuuaugucacagcuuccucuucagcugacuugaaagcuuuauuuuguucaaggucuaccgagcaaccaagaaagaagagcuaguguuucacggguacaggguggaguguucuggggauaggucagucaucguuucccuuuuagggagacuuggaucgguguuaaugaacuacucacaggaacuggccagaaucagagcccuugaauuuuaugcacugguccagggagguccugagagaguggaugcagagugcacugccuuuuuucugccuuugcuuggaaucccagaggagccagauuccaggaaggaaguggggcagggaggcagcaggguauaacgaacaaacagaaaaacaaaacaacaacaacaacaacaacaaccacccucaaaccuggucuggcucagcggguaagagcacugacugcuuuucugaaagccccaaguucaaaucccagcaaccacaugguggcuuacaaccacccauaaugagauccgaugcccucuucuggugcuucugaagucagcuacaguguacucaguauaauaauaaauaagucucugggccagagcaagcagaguuccuaaaauucaauucccaacaaccacaugaagguucacaaccaucaguaaauccauccauccauccauccauccauccauccauccauccauccauccauccauccaucuuccaaaaaaaaaaaaaagccaaaaccaaaggcauggccacagaaacaaugugugccuauugcuauuaguaacaagguaccuucuuccauuugggcugugugcggcuucaugguaguuuacccugugcugccuguguucauuuccacagggaccccaggauggcaggaagaccugcagccuucucaccuucagaaccagagccaagaacacagagcaaaugucaugaauggucagagucacacagccugcaggaggcaaagcuggaauucuaaguggcugagccuugaggucucaaaguuugugaccaauacacugugguggaccugccccgguuccagagucacuggaaauauucucauagcaagcaggaagaucucagggacagcagacguaguucuaaaugggcaugucuugcuagaaggcacagcugaugugccuuuuccaguaagcauuacaagaagcccauuuccaugguugaaaaaugcaaaggauuauucugagccaucccgaugauaaagaggacaacaauuugccuuuaaaaaaaaaauggaagcugggcacaguagcacucuucuguagucucagaacuuaagauggcugaggaagaggaggacuugggaagaggaguucaaaggcuggcaggggaaaacacaucaagaccuuguuucagauccacaacguaagcaaaccagaaggugguggcaaaccuggcggcgacgcuuaggacaucuaaauacucaauuauuucuacuucaaacaguguaauucguacaaacugguagagcacagaagcagaagaacauuaaacacaggauuuaauaauggauaugugcacacacauauacacuguugaagagcuugucgucugaaaguuucuaugaauuaaauauuuguucauuaacuacucgaguucacuugcaaggcaugccaggcgccaagggagagcacagaagugcacaaggccuuccacacaaagaccaggaaaggagaugugcacauagauaaugaguaaggcacagacuuaugucauaaagaugcguaucaggaagccaagagcacugccagccaagaccauggcguggaaaggcauguguaaagcaggugcucccggcaggguccauguaugcaugagaaucugcuggagugauggugggggugggccccuuagauccaugcauuucaagggaaaacuaucaauuaucaucuuuauuuauuuauuuuaugcaugugaguacacugucacucuucagacacacuagaagggggcaucagauucccacuacaaauggcugugagccaccaugugguugcugggaauugaacucaggaccucuggaagagcagucagugcuuuuaaccacugagccaucucuccagccuaauuaucaucuuuacugauaacuaaaaugccuuaaaaguuuaacuuaguaauacucuguuuaaaagguauauaacuaaacacagccaaucuguuuaaaacaacacaguuuccugaguugacuagaagaugcuaguuuuucauucuguuucuccugguacaagaagauuucaaacuaucuacaaucccucauuuaaauuuaaaaaccaaccaaccaaccaaccaaccaaccuccauugugagaggugccaugccacugguaccugccuccugcuccuccuauuacaaggaaggauggcuuaauggccuugcugggcugggcuuccugacugccuaacaguguggaaggcugcacaggcaguggagggaaaaaacccccaaaccucugucguuuguuaaaacaaacgagcauuuucacauucacucauacucccugaccccauagauccugugaauucuaaaaaggaccaugcuugaugagaauguuuuuuaaacauuaacgccuacaagguggagagccagaagaagggagccaagaguggauggcgacccucuuccucucaugcuuagcaauuucugguuucacuccuaugcuucugagcaccccaacaggaaggcuucacagcuccugaaggucugagcuagaccaggguacacaugaauaugcugauuauguggugcucaugcaaggagaccccuaaaagaugacuuccccaccuaaguccgaaccgccaugacucugagauaauuuacccaaaguuacauuucuguuucccaaaguauuaacaagaguguuuggcucuuuuaaaaagaagcuuagucuuucagggcuuuuuuuuuuucccuuuucuuuuuucauuuucaacaaauugcuucuaucgucugagaucuccauuacggaacuguuuguauugaguuuuagugaaggaagaaaaaaaaaaaaaaaagaaaacagagcggcugggaagauucaagugugcuggagacuuaacauuaggaucgggcacaccccaggcuucaggguuaaguuaaggagggugcuuguguccagugugagagguggggauggggauagaggaagcuuccucggaagacuugaccacucccccucuuuugugaagccuggaccccugucacagcgaguaccagaguacagcacucacccaugagccucaauuccaugugagccuauucuuuacuccacguuagucugccucuuuugcaagcacacucugcaacuuuucauuuuaaacuguguggugugcuaacgagagucagcagcucucugagugaccuaggcaaguucuuucuuccaugagcugccuccagcaacagagaaagggggcaauacuguugcagggucacggcaguugggaacacuuuuccuauaguuccagaauuacuggucuccuacccaaaccucagaucaucauuaagacaugcuaauguguagcgagacagguuggaaggaucuuuuucuauauaaaauacugcugacuggggcguggaaccccuguccuauugggugcuguggccaugcaaaaagagggucuuccaaaaauuuaggauuaagagggcauggugggagaggaacaacaaacuuuggaagccuucucaauguacuguagaauuaaaagccaaccaaggcaaggaaggugccuuccaaccuagaaauccagccacccucugcaacgagcccaggccugcuggagaccacgugaggugguaguggguaugccuggaaccuaacauaccacuucuaguaccgcccagcuggcacccaaucaggagcggcacagcauucucuaagcccagguuggcaccugcaaucaucuuaagcauacaauggcauugauuuccacuuaggguguagaaauaacacucagaaauuuuaccuaucucugcuguuuugcugccaaauuucaaauacucuccaagaaacgcaaacacaacagaacacggaggaugugacacacaaauucugcacaaucucacugccaauaccucgauguuauacucaguguauuaaauggaaucagaauccugagucccacugucaaacuuccuccucgucuagucgguaugugugacugacagcugaugucacugaaugcuugaugucugaaaugccuaggauuccuuuuucuccccccauccaaauauaacagcuccauuucauacucccuagaauuucauuugugacugguuagcacacuaucagugagggaacacgggggcugcaggaagcucaccguccuuacagauuucugggagggagcucaagaguaaguaaguguguaagccuucauagcucuaccaaacacaugcauaaaaccugauuaaacacagaggaagaacauaaauauucucagucuucuaaggggcagaugaagucuggguaagaaggacuaaagaaaaagcauagaguaaaauucgcucccgcuuuuuaauaacucuuuaagauaaggagaguuguuuaauguuuucaaaauaggcagagagagagagagcgagcuagagagagaaaguaugugguauaguuuauguguguaugugaugugauuuaugugugugugaguguguguaugugguaugguuuauauguguguguguguguguguguguagcacugugacagagugugugcuuggcaugugaaauccccugguuucaauccuuccccuucagaauguuuccuuuggaacaaaccaauacaucuggugacgcugaccuuuagugccccuccuccacucacccuguuuucuacagcaaaaguaucuacaaaaaggaagccgugccucaggaagucuucaccaaagcuugaagagcauggagagaagaaguaagguuccaucagaugccuuguguugagguaaguccucccucccaaucaacccacaaugaauauucucugaugucagccccucucucugagcauccugucucugagaccuuggaaguaagacuucugugucugggaccaaaacuacuggggcuauuuuggcagcugagcccucugccuccucugcagggaaaaacaguaggaacauuucaaauaacauucauauuugagauauuuucuggcucugcguauuuuucuacuucauagcacguguaauuguccucccugauaaaaguggaccuagcacugcuauuuuaaaaguuuuguguucuacacuuuaaaaggauacacaaaguccuagcaggagaacgucaauuaccaaguacaaaaacaaaacaaaacaaaaauaggaaaucaccauuuggccaaugccacagcaauggguguugaaugaggaggggaagaaauaaugaacaguguguuuagagagucccgagaucugucucaaaguacuucuuaauuagagauaaaaauaaagauguuaagugacgagaggaccuugcagagacagcauuaaccaagugucacaauuaccuaagcauggggcaucaggugcccuggcaggcugacguacugacucuucacagcaggaaagagcacaggaggcuguguguggggcugcaaggaaugaccucccaugaaguaccuggaucgagcuacugaagugugggaaaagugucccggaaucggagaaaucaaggaggacaggaaucagagcugggugggcaccgcuccuggaucaggaaccacaaauggcacaagagaggucaaagggcacugggaagaaggggcagaugguggcaguacagugcaggugcuaccuucaugguucggacagcuucaucgggguuuuguaagaugcuaauuagaagaugucagacaccucccacccccacgugugcaaaacugaagcagaaauauuucauauaaaacaaaguguuuuuuuuuuaaguuccuaagguaaauaaaagcaacuuagugacauauggaacacaauguccccgacaguuugacaauaaggcaacacucuuccuucgggaggagagaaaucucuacuuugcguagggacacaucaaggauaugcuucuuuggaaggucuucaggcuggcagagcuggucaccaauggggauggugugggggcguuuacguucucacaauuccccaucuaucucauguuacccuccagugcaacggaaguggaggguacacugaguguucaugaagagaaagccguuaacgagaugcucaacgagaauauaaccaucugucgcacuugucccgcaugucccaugcccuuuuccuaggcugcaagcacgcaagugguacacagauacacacccaggcaaaacauccauacaaacuaaacacacacacacacacccuuuuuggguccuuuggaguccuuguuuaugggagcagacauuguucugucuucugucacagauagcauccucugagcuuggaaaguuuaacaugagauugaucccacucuuuccaagggggagagggagacuaauguguaagcagacagcucccaguaucacaagccuuaguuuccucaucuaucacuauguggugguagugagggcaguaaaaagaccuugucaagcuuugacuagaacaaccugagauucuucauucugggaguagccuuaaauguaacuauauucacuggcaaagaagaacaaacuaaggccccaggugaauguaagaaggcuaccauuuuuacuucggugaugcugaguguuaaggcguguauagcacaacagaggaguacuccaccgcaaagggaugcacugucucuuuggagucgaggugcccccuccagguaaugagacagaaaggaguggauacagcugguccagguucuuggcuggcuccgagagcuaugcuaaguccucugaaucaaugguaugacacaaguuuguucucuguugagcuggugucuuacuucaucaccagugcucaucucuaacucccgagcucaagaaauccuucugcaggauuggagagauggcucagcggauaagagcacugacugcucucccacagguccugaguugaaauggcucacaaaccaucccuaaugagauccgaugcccucuucuggggugucugaagacagcuacauguacuuacauauaauaaauaaauacaucuuuggguuggagcgaacggggcuggggagagagacgaaaaagugucugaagauagcuauaguguacuuauauagaaauaaauaaauuaaaaaaaaagaaacccuucugcacagccuucugaauagcugggguuucaggcuugagcccccuuuagagacaggcagcagagacacaaaggccugcccaacauguguaggauuagauagccuggguauggcugaagggaacagguacucagguuggcccaggccaggagccagacucuaguauauuaugcaagguugccuccuaaauuauaaugcacuucauuugcagagaguccaacacuagacucauggugucugguagcccagaggguaacaggcuguguucuucacagggaacaucugaggacagagacggaccaagagggcucuugacgguggcuggugguaaggacuaggagcgcuuacggcgagcugcuugggagaagccuuuucaggugguuaucugagagaaggcacaggaagucaugaaauuaggaccugaggacuuguccaggauaggcgcaguagugagaacugcauccuugugaagauggguuugaccucugcuggaggcuacaaugcagcuaaaugugucuuuaucuuaaugacuccagaaacgccaugcugugaaagaagcagguagguagagggaggucaggagagcaaaccaaccucacgugaaggguaacucacagacuugucguucacuuuccagaacccaacccucaaaagaacauacuucuaggguguagcugggaaccaggaagcagccagcucugagcugcugcuugcuugcucucucacacagugguaacaagcaaugcucaucucuuuucaaagcacuccaagcaaauaaacaccugcagaggagcugauggagacagacuucucuuacuggggugagucuauuaaacagaaaaggaggcauaaaaaugauaaacccagaccgucagaacacagugagugcaagaaacugucagcagagagcgaacugcuuccuucucacgccggagggcacugcuggauuaagcauaauacaaguuauguaugcucgcugauguuccugagcggguaagaaauaaccaguguucacuagaguaaaaagugcagcgguucugaaugcaugcuggaaagaucuccagcaagggacagugcaggaaaacgggagcagaagucucagcccucggucuguguaucaccuggucacgcuuucucacugagggauauugguccccgggcaugagaggagagguuccugcuaccuagugacuuucucaagacugacuuaccacuaaccugucuccuauagugucaggagcuugagucugaaacagucuucacuaaauuuuuggcuguaacugaaacuggacuaaguaauuaaaaagguuucaauauuuaagcucacauuuaaguugggaauggagggaugguuugauagugaagagcacuggcugcucuuccagaggacccaggcucaauuccuaucacacauggaggcuuagaagcaucuucuucaggagaagaccuacaggggaacuaauauccuuuucuagugcacacauuuaaaacugaggcuuaguuuaaacccuguuuuaccaggggcaggggugucugugcacaagaaagacagacagaguuuaguuuuaguucuagacuucuauuugcucaccaggaaaauaacauugguagacuuuaccaaaaucugcagcaaaaacuaaaugauaaauguacucucaaaacagggcucaauaucccacaggugaucagggucaacuuuuccagggacccuggugucaguggguuuuauacuuggaaugagaacacaguaaagcugggacugccaauauuccugcuaggacucuuuauuuucuuuauggcuuccccuagcuuauuuagaagacaggcuucugucccucagggacuggacuucucaagagcagaacacugcuguaggaaacagugucuuccaagagucaagggaaggaggaaugccaccacugagaggagauggcuugcuuuccucccucaagaaaagagugagcaaggcuccauccacggcguguuccaacaccuucccacauagcuggacccagaugucauaggggacuugcagaaaggaaguuucaacaucagcuagccuuggcagaugcucccaagucguucaaaaauaaaacucgggcgaugacgguaaagaugggaugacggcuuaagauggagcaagaggcuuuccccguggcgggccucagcuuagugcuaugcccgcuugccgucuuguucaggaacaaaccggggcccagaugagaaacgcgcucgcguugaccauccagaaaggcagagugugugcuucugaaggcaguguucuccagccuuucuaccuuccauuaaaugguugagucuguccuuguguggauugauguuauuucuaaagcacacaauucauuucaagaggggagaggcaggauuaagcuggaaauaguuuuuuuucuauugagaaaaaauuaaguguaaguggaaacguuuucaugaaaauguuuuuauaucucaacguuuccugcgagcacucugaucccaauauaucacaggacugagcuggaugagggagaaugaaggcaaaaugaauuuaaauaaaauugaaacugaccggcuaggcuuuauucuccaaaucucaugaaauagcaaagcugagggggacagagccacaaauaaaccaaaagaaaaaaaaaaccaaacaaacaaaaaaaaaaaaaaacaagaagcaacucaacgcuuucagcucaaaugaguuucaauuuuauuucaaaauguuuuaaaaucuaguuuauuuucauagccacaaaagcuuuugaauaccuaugaaucaaaagccauuuggcagaaccauggagcuuguccuaguugcuuucucucaaacucuucccugggccuguuaaccccuuguuagucagucacgcacagcaggucacucucaguacccaguucuuaggggcacucuacagccuuaguguguaugagcaggcagaggcucuaggcuggacggcacauuuuuaaaauacacauuuuuaaguguauguauuuuuuuuuauuagucuuaaauaggauagggaaaaugauauauacagacuuuaacuacuaauuacuuuagacaaagaacaaacagaaaacaaaaaacaaaaacaacccccuccccaaacccaaaccaaaaaaaccacuaaaaaacaaaacaaaaaaaccccaauccacauccuuuagagauuauuuuguuaaucugcaucuugaucugugcugcucaggggccacaggaggccacaggaggccucugaaacuugaaacaguuaagauuaaguaaaaagugcaacgaagagagcucaccacauccuaaauguuucucaacuacucaacucccggcuaccacacgcagggcagacacaggggaucugucgaggcacaagacuacagaguaacagugcaggucagacagaagagcagggguguggucucaguccagcucucacauagcucaugcuggccucaauuucgccaugucucugaagauggccuugaacugaucuuccggcucccuuugggacugccagguguguguuacucuacacagguuacguaauugucaggccuuuguguuugugugcauuucccuaagcaacuucauguacaaagcuaaguuggguaugcauucucuccccaggccuggccccuuacucucuaccguaaaaugcuucuucccuaacaacccgacuugaguggggucccuacguacagagaaaggagauauuuacagaagaaagggcaaaugacugcuuuuacagggaaagagcaucccaggucaacacacguaccagauuguagagagggcaggugucuccauccccgugccucucuauuuccuuuccaacacucagcccugugugagcagagaguaaggccccucuuugaugcugcaccccccuauuauaagcacaaugcuuguaaccaaacagaugguuggauguuugggaaaugacugaaugaaacaaaagaagaaugguauucuguuaaacaacagccaacaucccucuagagccuggacacacgucuuuauagagccuggauacaagucuuuauauuggauagcaaccucuuuacuuucaaaugcaaucucagagcaacccagaagacugauucagguaguauaccacagcucagucucuuccaugcucaacaauggcuccuuccaaauggcauuagcguugucuacauaucuguacagucagagcuaaugucuaucuguucgucuuuaaauggcccagagcuuuucacuuuccauauacuauuucaccuacccuucaccuggauauugucuauacaauaaagaggaggaaaccaaggcuugggcgaaacugacuugccagaucacauagaguuauagguauauaaauggaaaagcucugguaaagauuacagacuaugcugauucuauuagcuggcuguaggacagcugaauggaucucuuucaaggaagggcaugauuuguaagcaucccacacgucagugcugaguaaggcuccuaaguccugcuggcuugcugccagccaguagaccccuuccagggugagggaacugggcagagcucagcacaacccagcucaccuaacuguggcugucagaaucauuggauccugcccaucauacauccacucuguggccauaucccgcagcuucacaagcuucaucagggucgggccugugucugcaaaaagaccagcuugagaagaccaggagguguauaucaaguaccacucguucauucguucguucauucacuagucagaacuucaaaccaauaaccccagaaguaaagacaaaaacucccucugcccucugguggcuugaacuucccucuuggacccaauucccacagguuaggguuuccagaagcuuucaaaaaaaaaucacugaugaaacacuagcucuuuagcuuagcguauuauacaaaaggcugauuuccgauuuaucaaaggguuaccaaauaggaaguauaaaaaccguaugauccuuacagggaauggucaaagagcagugaucaagucccugauuuacauaauucucagccauucuuuuggcagaccucuacagccacuaacauuuccaucuacggaugauaaaaagauaacucuucccccuuccugggugccugucagguauaaacuugaagccgggcacaguuaauccucacaacuccccaaggaagagguauuaccauguuugcuccagauuaagaaagaagggucaggccugaauuccaggcaucagaauucuacugagagggaagagagacagacagacagcuuucacucuggccuagagugcagagaaaacuacuacuuucugugggaagaaaagucagucaaccacaggaaucacagaaggauccaucacaagaggacgccacugucccuuaagcagagacaggacugagaagaacaaagguacuacugggacagaauauggagaggucagcuugaggaagugcucuagcaaauggcaucaaggaggccauuuccccaacuggagagagaccucagauccucaccacaggagccagguagcacugugguacgcacacauaccauguguguacugauguggugggagacacaggcagagguggcagggugaaaucaggucaagaagaacugagagccaggccggggccacugcucugcccugcuuaugaaagccaggggauuaagucaagacuucacucgugauucaaaaaguuaucugaagacauggcgggaaguacagcuaggucucaccaccccucccccucccccccagcucugcaugcucaacugaggacgugccacuuggcacgcuggcacucuccuacaggaaaacauacuuuggcuauucagacgugacuuccuggcacucggaagcuguuggcauggaaaaauuaacaggcugacuuggccagggaggaacgguuaacacaaaucaccaggaaaagaugagcccugagcaagcgggagguuugagggaagggucacggaaaaaagaagggguaagacacauuugucaggagucccaggcugguaccaagcccacugcaugacaaaggucauugagcccucacagccauacacagacaucacggcuuuccuuucaggcaguggacaaggaggcuaacggaggugaacuuacuuggccuggaugaggcagcuaauaagggacaggagcugguacacacaucaucacaacauucuucauuacggucucuuucugccuucaaccccuugcccaguuuguaacuucauaaggugggguaaugaugccaggaacuuuguagcccugaggcagaacucugccccagcuguggccuucguaaccuccccuuacuacaagcgacacagccaccuccacucaaauccugacgacagcucaguauauaacgguagcguguuacauacuaacuuggucauuuuggggaaagcugcuuguguguguaaaggggggggggugguuuggggcuugggaucaaacaaaugaguaaguaggaaaaaagaccaaccauccacugagauccuaaccaggcuuucauaacuuaagacuggagucuuccacaaacucacacagguagccauagaagcuacuccuggaaauccaauccuggccagaacaugcuagggccacccacauuccuaccugcagcaaccuuccuuucucccucagcaucaacccuaagauccuccagggcucuguagcucaguaacuuugcaggguguuaagucuagaggagcccagagguccguggccucccauguggggguuacaauuccuacaaccuuaaauccuguaaagcgugcccacaagguccuucagcuucucgccagaacuuccaaaccuugccuuuacacuuaacaaagcuuccuacuaaauaucuacaccaaauuuccguacauuaguuuuucuuucugcuugugaaaggggugguggugguggugaaacuagucaagaucggauauccucugcaauaccagcuucuagaaaagagcguuuuugaaugggaugccacgugcuguguuuugccauauugccugcgcuuccugcuuggagccagaguaacagaaaccuugggcacugggaacuguuccgugccacgcaaauuccacuccguaucuuccaggcaacccugucgcaaauaauucauguccacuacgccccuaccacacagaauacaacuacauugugcugcuagaaaugggaaaccugauucagaucagagaagguagaaaaacauuuaguucaacacaauacugccuuuaugaaaaggggcgugcgccggguggugguguaaaucccaaaccuguaaguggggauagauuucaagacgaauuuuggaagaaaaugcagaaucaaaauagcauccagcuugacucagaccaguaauaauaauaacaacaacaaaaacccagccaguccuucuagagcuacgccuguuuaggcugcgcggugcucuuaauggccagccagccuguucuccugggaaauggugcugcugcuacagcgugacuugcuuugcgugcugcaauaaaaggaaaacaagcuugcacgacccaauagcuuccuucaguuugugccuagcagcggggagaaaauuaaaaaaaaaaaaaaaaaaagccugaaaagggguccugaggcaaggugaauggaggacaggauccuagagaacagcacugcccugcaggauuuuuguaaacagcagccuguaauggccacgguuagagaaagaaaaacagacauggagggaagcguguuuacaacugcagcaagggcgggaggcggagggagggauuccccggcucugcgcucggcccucuucacuccgguggggccccgggguugggcugagcuucagcuccccaccccaauccgugcuuucuuggggggccccccaucuuguuuaugggaagguuacuccuccucggcucuggugaucgcgucccuaauacuccagcugcauccuugcgggaugccagcuugacugacaaguccugcagccaaucgcugguugggcccuuaggaaagguggaauuucccaacaaacugauuggcugagagagagggcgggcccuggugauuggcguguuauuccgaguagaaaguaguaaacaaccuugguccaggggcgguggggagggcgcccggugccagcucccucuggcuggcagggcgggguggggaagcacccgagacaaaaggaauccuggcugccacagcggggagggcaggaaggggguggccccaaaagucagcaccuggaggcgucguuuggagcccccccccccccccccccgagccagaacugcugacuuuaagccacacaucguuuuuuuguuuugugcagaaccucaaagguuuuguuuccaucauuuucacuucuuguauggcugacgaagucuccaauggaaugauaaccgauuuagucgcuuuuguccagaagccccuuccucaccgucgaauaaaaauuuaaaauugucuuuuacgaaaguugcuuuaaaucacacacuaaaauuguugcacuauacaauacgccauuaauggcaugcuggugcaccagacacacagcuacaucuuuugauagcaaguuuuaggagcucugagccuauugggagcagcugggauggagaacauacacaaaaagaaacaacacaugacggcguugggaccacuugauaagaaauaagcgguuaacuugccuugcccauaguauuucuggcagucucacuugaaucucccauucccucacuccagcuucaccauccuuacaggaccccaggcggaggaaaccaucugcucuuaggauggggggcucugcucaccccgcacauaaacaugcucacaagucgcuauccugagcaagccuccucaauguaaaaggggaccaggaggccagccaagccggcucucuccacuucaaugcuuguugaauauacagagaccacguugucacuuuucacaaucaagauauaucgguaucacgauauaucgauaacggguacuuuauaggagauaacagugcaaacuggccaccuggcauucuccuuugccauucuagucccucaccucugcuaucuccuauggagccugccacaagcaaccccaguaaauguucaccccaagucaccuuugcuguauaaaacauggauuuaggcuuuccuugguccuugcagccuggcaucagaccccaaaccaguagcuacuuucauuguaggcacccucccucuggacacuuuguucuguucccaggucccugcccagaccacacacaucauuuuacucaacguugguuuuuaugcuuucuagacuuuaccucugccugcccaggagaggccacuguucuccaccguucucccuggcccagcuaccccacuucuugcagaagacugaaauuuguuuucuuagcacuaagucucugauagggcuuuaaugcuguauuuagacuccacuccuacguuaagacccugaacuuccugaggccuggaaugguauuaucuucagauuugggucuucaguggagaugggcuucuacuaaagugcccgcugcaaacuugccaaauauuucuaggauucuucccuagcauccugaguaugccuaccccugaaaaucuuuccuuacacacgugcaauuaauguguuuucucugcugggucaacaacucuguuuucucuacuuggcaaauuuccacucugccuaaaaucacuuccucucuuggcauaccuuucacaaccucccaccaacuacacuguguaccaagagcagagaggucucuuuccguucuuacuucucuggccagaauuagcuacaaaacuagaacuagcaugguuuguugguaaaggaagagcggagaggcaaaauuucagaagugguaucaccuguacaucugcauaaccaacccauugccaucuguaggggugaagcagcgccaugcuccguuuguggcugugauggucucccccugcuuucugucugaaggccucugucucugagguggauucuuacuccccccuccaucucaaucagagaucuccuccuggcucuuaugcuaucaacucugcacauccccgauuccuuuccaccaugacacugaacugucaucuccuuuucuaucugaccagucacugacuugcucacaguuuagucuguccgccauacagccauauccaguguucuaagaauugugggguuccacagcuggggcucagucucugcuuacgcccucaugugacaucugucaucaacccuccaucuuucuaagccuuuaaugguggaaaagaguaaaccuguagauaaagagugguaccagauuucaccuuaagauuacagauacuuguuugugaauagaauuuguucugguacaggcaaaugcacgguuuaaaaucaaaacuaacaaaauauacaguauauuagcugggaacaaauagccaacuaaagcaauguaaagcugggagucuguauucuggcucaaagcccaucacggugaggcaaacaugauggccugagcuucaggaugcucauuaccacacugcauccucagucaagaagcagagagaacugguucccaggacaggggcuggugcugccuaagucuuggucuucccgucuuuaaguuaacacggcccuuggcaggcaugccugaagcuugacuuuucggugauuacagacccuaucaaacaccauaaauaauaacaccacacauauauuacauauauaaaaacuauaacacagaacacucaauuggcuuucaguaagugggcuauuuuuuuuucuuuguugcuuaauguauucuagaucugucuauguuuacaaacgguaugucuucucuacuaacaaauaggauuucaaauuaaaaagcugaacagcaaaggagacagugaagagacaaucuguuagcuuuucaucugacaagggauuaauauacugaauauauaaagaacaaaauuuaaaugucaaaagaacaaauaaucaaaccaauaaaugggcaaauuaaucaaaugggcaguuuucaaaagaagcacaaaagaccaauacauacaugagaaaugcucaacacccuuagccaccagggaaaugcaaauguaaaccacaccgagauucaaaucucaccccauucacaauggagcacauuaagacaaccaucaacaaacacuggcaaggaugcagggggaaaugugccuguacacauuguugguggaaauaaaaaugaaguaguuuagauacuauggaagccuauauggccaaaaaugugcuacuaccucacuucgggauguacagaugugaugcuaagucagcacacgacacauccacguuacuauccacaucagccaagcaaugggaccaggaaaagaugaaggaaaugugaugcacacgcacagcugugucagaugucaaggauaaaaccaaacuaucggcgggaaguuaaggaguggacaaucaucugaagugacgcuggccagaccaaagccuaucucaucuguguauuuuuuuuuuuuaaugaaaauaaaagggaggcuuuguacagagggaggaaaugauacagaagggaaagaagggacaaacagaagauaaugggugguaaucaaagcacauuuuguauauggaugaaaguauuaaaacaagaaaacagccaucuuaucuucacagacagcauucugcucuauagauaacccugagugguccccaaccuugccuguguguuuaaaucacuguuacuuccccagaagcggauuuaguugguuuagaggcuaucacgugagccuugaaaugaaacaguagaaacaaagucccagaugauucuaaugaggaggcagguuugagagauaacaguaaaccuauuuauuaucccucuacugauagaacuugucauuucagacaacaccauguaaaguggccuaauacaccugucaguucaccggugugcuggugugucugugggugaucauccugggagaauuaccaugucaaagggcacaggcacugguacaucagaaaugcuggcaaauuacauuccauuacacacacacacacacacacacacacacacacacacacacacacacacacacacacaccaucuuccagcccccucugccaaguggggcuguuuuccuauagaucugucaucagaaucugugacugaacauuuuagauuuucaagcauggggggcugggaggagcucugaauacucauaaaaaggacuuucugauguguucuacuacaacauuucugguucuuuuguuuguuuguuguuguuuacaccuuuauuaugaauucacuuagagucuaacaaggauggacccaugauccaacaucaguuaaguaaagagcguauuugcuccaaugauauaaaacgucaucuuauuaaacaacgaacggccacauguucucacaucuacggcuggauaucauauucugucccuucacauacuggcaccuugcuagcuauuuaaucauuaauuacuuaggcaccaugggaugcuuuaauuaucugguaauuucguugggcuuguuuagcacuauuacuauuaucaccauuauuauuguugcuauuauugacgacuguagagucaguuuguauaauuaaaagaaaccacauaguauuugaaguauauuaacuuuauaaacacaggaagaacugacaucuugcuaacauugguuagacucgcauuaaagguaugguucuaucauuuauuugaauuuauauuuggcagcauuuuguucaguacuauuuuucuuauuaauuuuuaagcauuuuucucugggaaaaacuuuucuucuaugauguuguauagcaaauuauuugcacacuguagcguuaucacaugacuaagucuggcuuauguuauuuccagaagaugcuuaauuccaugcccuuagaaucugagcauguaugcacaugugugaacccacagggcaacucugggugcuguuccucccuccacccuauuucagacagguucucuugcugggcuguagcacaccaaugaagcaaacaaguggcuggccacaagccccaggggucugucuaccucuguuucuacauaacggagauuucaagcuugugccacugugcccgugauuuuuaagauagauucuucgacuugaagucaguuccccacauuuguguggcaaucaugccauugauggagcuauuugccaaguucccugugcucuuagaacucucaauaaauaaacgacaccaaaggucuuuuccccucacuaguaugaaguuuauuauuuuuuuuuauuggauauuuucuuuauuuacauuucaaauguuguccccuuuccugcucucccaaaaacccucugucccaucccuccucccccugcuucuaugaggguguucccccacccacucacuccugccugguggccuggcauuccccuagacugggguauugagccuucacaggaccaagguccucuccucccauugaugcccaaccaggucauccucugcuaugugugacuugagccaugggucccuccauguauuggugguuuaguccuugggagcucuggggggucugguugcuugaugucauuguucuuucaaugggguugcaaaccccuucaguuccuucagucuuuuuucuaacuccuccacuggggacccucauuggggaccacauguucaguccaaugguuggcugcgagcauccaccucuguauuugucaggcucuggcagaaaguacuuuuuggcauccacaauagugucuggguuuggugauuguauaugggauggauccccagguggggcagucuuuggauggccuuucuuucagucucugcuccacacucugucuccacauuugucccggugaguacuuuguaccacuuacuaagaaggaccaaagcacucauacuuuggucuuccuucuucuugagcuucauguggccuaugaauuguaucuuggguauccucaacuuuugggcuaaaauaccaagguucuaaucaacucaauucaaaccaauaaauuuugacuugacauuuacaacguaagcaauucagauguagggcauagcacuagcugguagaggcaagacuggauauggggagcuucuaacccaagaguggaaaguguugggagaacaagacugagggcuuggggcagugugggugagguggaaagcuaacugcgugccuuagugcaugccuuaggaaaguaucucagcuaggcuacuauagcagcuaugcaucuaucuauaccagagaaaccccacagagcuggacauacagaugagcucauucaugucugaugagcucauucauacacgugauagccaugauguucugcugaacguuuuaugagauaaaaccaaguuuccuguuucagagcuguguguuuaaagguaugucccuuuaugaacauuaaacaaccagcuguaugugguggugucaauaaucccagaacaagagggcucauggaagaagggucuuaacuucagacuagcuuggaauaaauagugcaaccaugucucaacagacaaacguaacuaaaauaucaucuuacaaaccaagaggucccagcauaaauaucagagcagagcugcccagccuuggucucauuccagaccucuuaaccuaugaccucuugggcugaggucauagucggcauagggaagugccuggcuaguaacaacaacacagucacacauaucuguccucaaggagcuccucgaguaaacaccuuugcucugaugaugacaagcauggccacagucccugugcuugcagaaucuugguuagaaagcucccaacaccaccaucuuccacuaguuagccucugcuguuccccgaacugaaucccuaaguaccgaaugcucuccuguuccacacagaaaccucugagaagcccaguuuacagaaucagagacugggccauuccucgaagcauugcuaaagaacuggcaggagucacucaaguucucaggagcuaugggaagauaagauucuccccaaugcgguugcacugaaagacagggcaguaaagaacaauuaugccuaaccccgauuucucucugaauccauuuauuacuucucaauuuaggagagucacucuuguaccugcacccuggccacuacucagaaaaacauuaguguauccaaugaucccuuuaguaacuacuggagaagcagcuagcugaagcaugggggaauuaaggaagaccuuaggaguucaaaaccccaaaguacaaacgcacugucagcacacggagagaucuguuuuuuuaugcaugccuuaugcaaacuggccuaagcuaaaaaauguuauaaagcauuuugaggaguaaauuuugauuucaggguuaaaaagaaauguacagagucaaagaaucuuucuguuggcugauaacagagacuccuuggaaaaauugacauuucuuuucgagaagcaaaagguggaguagaaauagugugagcagcauaugaugucuugugacaaugcagagaaggcaguugggagcugccacuaaugucgaguuuucauuaggcucauaucuccaacuuuugguuuugugaggcugcaacucaauuguguaguaaaaaaaauuuguaguccauuagggugcuuuuaauauucacuauaucuacuaugaaauaggagcuuagaugaugaugaugacaacaacaguaauagcagcagcuacuuugaaacacucacaggcauugugaguuggagcccugagcacuaaccacuguaauuugcuaucaggaccacuggguauggcauucggaaaacggacauaugcaaucaaugcuugugacaugggagaacaaaaccuugucaaccaacugcaaacagauggcucauggacaacaaaaccuuagagaaaaaugcaggaauaucagcggggcaguggggaggaaaagagaacacuuuccagacuguaugcauagaagggccucaaaggccgccaugacagauguguuccuguaucggggucaacaaagaauaaagcccauagcacaauucuuaggaaaaguugaaaugccuguuuuguaaauaaaacacaccgacuuaaauuucuacuacuuaauuuuauaaauuccgcuuaaauaugugucuaaauacacuuuuuuccccuuguuuugagacauggucucucuacguagcccuggcuauccuagaacuaguuauguagaccaggcugaccccugacgcguggggacccuuuugcuucuucaucuggagugcugggauuaaagacauacaucaaccagcugggcuuaagugucuagauuuuuaacuucuuuauauuuauucuuacccucaguguuauugaacauugacugugcagacuucagaguuuaccaaguuugaggggcuggccaaauccuucuggacuuacugagaaaggaacagacccaggacaccgacuggagcuacacggugggcgccauggcgccaggccgagacacguggauccuucggcuuugcuucugugucucagcuaccucagagguuugcuguggaaucacuaguauuuuaaacaaugcaaacgcaauuacaguugaagcacauucucuaggagaaggaaaaggagauuggcauguagaagcuucauuaaacuuuuggccuuuucaaagcuaaacgagucuuaagaaaagccauaaaaaguucccguugauugauuuaaaaacaggcuuuuuuuuuuuuuuuuuuuuuuugcaauuagcagaucuaaaucuacgaaagggagaaacacguacggcacuuuuaguuaacuuccugcuuucucuguguauuucaaaucguaacaauuaagacucucuauagacacacguacagauacacaaauacuuagcaggacguaaacuucuauuuuggcuucaugaaaaugguaguuauguuuccacacacacaaugaauucuggcaguuuauuuacaagcagacaucccaucugcaccagggauaauacccucaacuaugugacaugcuacaucccuccugaacacaguagggcuaggaaagcacugagaggauauaaacauguucagggcuuacaauauuccuuccuaaugcuucuuuccccaacuuacuguaacgauuuacuggaaagauuggacuaaauuaccgucuucccuuuaucgucccaauuuguuugcauuugguauccucuccuuucucuuggaaucucccuugcuuuuccuuuugucaguaaguuaaauugcuucuccucccacaugcauaaaagcauuaauuuauaaaacacauagcuguaugucauaucucauguaauucuauuuuacauuuuaccacuagcuagacuuaucuaacaugaacaaauagauauuauuuacuguagccagaaugagaauuaucuaaugccacuuacauagccagaaauugauuuuugauuaauguuuaagcgaaaagcaaacaaacccaucugcucugaaaacaaacaaacaaagaggagcagagcacugaguccucgguucgcaggcauuccugcaggccuagugccucagcggcugcagaauggggcccuucaccccaggggaaagcggaccacugacaagaacaggacuccaggcccagacuggaguuucuucuccagcaaguguugaguaaaagauuuuuuacuuauugggggggggggggagacgggacgggacuggggaccacaaacaacaacaaaucucuaaacccucucaggaucagcagagaauuucaucuugggcgcccacuggaagucaaggaaguuguuaauggucauguuuuccuucuucccucuuguucacuaggucaguuaaaagacaaagaaaaaggcugggcaugguggugcaugccuuuaguccuagcacuuagaaggcagaggcagagguucucuuggaguuugaggccagccuggucuacagaguuaguuuuaggagagcuagccuucacggucaucugcccacacacacacacacacacacacacacacacacacacacacacaaacugacaaaauguaaaucaagaaagaaacaaaaacaaagaaaaacagcccugugccauuuauucuuauaaucucugcgguuuccucaguaugaagaacagagugcaguuuauaguucuuguccacuccauuuauauugaauauauaaauuauuuucuaagauacuuauauacauaaccaaauuuguuuuuaacaaauuuaaugaaaacauucagcaugaaacuaaauagcaguaagacucucagauggugucuuagguuaaaaacaagaggagcacuccaaccuuuucuuugacaaggucucuuguaucccaggcuaacccguauguagccgaagaugacuuuuaacagcugacccagucccuuccaccgcuucuguuguacuggaucccagggccuccacgcaccccagagaagcacucuaacaacucacugccagcuaagcuacagcccggccuccuuuggagcacuuucaacagccaaaacugacacaauacauacgcaucaacaagcaagcugaacacccaccaccggugugcugagagaagagacucaaacucacaacuuucaaagucccauaccaagccugaugaugcaaacacaacuugaagucuuauuggcgacgcuccggauacuaccaguugcuaaaggaacagagugggacugcgacugcauucugaaacauuuucuacaaauacucauccugcacgaagaaguaaggugcaagugccuuuaugacucuauuuccacucuagacgcucaggcucaaggcagagcgcuuagauccugcugcacuuccauaaaaacaagccugauuuaugcugaaagacuuuaaugacaaaguuguccugaugugcgugcgugcgugugugcacgcgcacacacacagacacacagagagagagagagagagagagagagagagagagagagagacagagagggagagagagagagagagagagagagagagagagagagagagagagagaggaccuagagaacaagggccuuugucuugcucugccgaagcacagugagcauuuccugagcccugauuuagccuuuaacugaugguucugguuugugcuucaacagaaauaauugcaugacugaccaaaaaaggaaaggccaaacaagucuuaaauaaugauuguuggcguaccaacugcaccaaccuuuucuaauuacaacucuccauuuuauuauugucaggcaaagugaguaccuuaacuugaaaggcuaagcugagggggaaaagccuuuuugucucuacuuuacagguuuguuuuuauaaacacucccucaguccccccaaagcaacaggaggcaggcacaaugacccuacugaggaguacagcuuuuaccuccaugggacaauagauugcuuuucuguuagccccugggaguaaaaccagcuuuaauauggaugcccuuuccuuaucaaagacagcaggguaauacggggagggcugccaagcuuggguugugcggacuuggcagguaugaggccuaccucgcuucuacaccacgucacucaaggaacagagcagaagaaacacguucuggaacuuuccagagaggccauccuuguucauguauucuaguccagaguucuacuucucucuacagagauggaugaaacaaaagcaaaacaacacagagaaaaaccccuucuaagggagcuggagggaggagauaaucuagagagaggaugccaaaaguggcuuguuuccaagugacaaaaugcaccuuugcuggggaagcuagcaagguagaagccccuguucagaacuuuucaaggagcagaugaagacaaaaaaaugccacgcaaugggggacggaauccucuagaugucgagaaaaagcagcggccaugcccagggagcaggacuagagagaggcaagccaacuccugcucauggcaaggcggcuugccucuccagcgcacucugcagauguuuccgcacguuguuucuauagucugaagacacuccgcuggcaguguauuguuggaugcuggcagaaucucuagucaagacuagcaacuccaccuccuuccugacaucagcaagggggaacacaccaggagccaggagacaagguguaggugcaggagacaaacaccgugugugguccagagcugaacuugcugcuggagacuguccugucaggaaaaguaaaaaacaaaccaacacaaaaauccaggaggugcagagguagaggcagaggcaggcgggucccugugaauuugaggccagucugcuuuacacagugaguuccaggacagcaggggcuguauagagagacccugccucaaaaaacaacacaaacaaacaaaaacaaaagaagggggugaagaagagagggagaagguggggcgggggccagggguuggguauggggagggaaacuuacccugguggagacagugaaacuguuguuugccacugccucucuuagguagggucuaacuguacuccugacuaaucuucaacuugcuguauuaaucaaguuggguuccaacuacucuuggaacuacaggugcaacccaccacaccaucgaagucuuggcgcacagcucuagggggcauaggaaauggcuuuccccgugcccuguagaaauggaacugaaagcucaucauggcgguaagacuguuuuuuagcucacacucucacacugcaaaugaccuaaugacacagcagggccuccgguaccauccucacucccacgcucccacuccauccuaauguuagcucacuuacucagucuaccacaggcuuaggugacaucugaaggaauagcauacuauaaaaaccugacuuggccaccacagcaugcaagcucuaaggcagguagaacauacuggguuuuuguuguuguuguuuguuuuuguuuguuuguuuuucuuuuccaguuucuccccucaaagaucuucacaucaugaguuaugauacucguucauuacauccuccuagaauggcuccagucaagaagagaaggcucaaugacccaccccaacugcaaaagcaaaauuaucuuagaagaagaagaaaaggaauggaccauguaauuaaaauuacgaggggcagugacuuacagagguaaaaaguuaaucacaaggacuaucucaaagccuagugaaaaaugggguuuucagaaucagaccugucaaagguaaccacgagaugcaauaaugugguuuggaagucugggugacgggcagcagcaggaacaggucagggaaggggggaguaaauuguuugcaaaaugaaaugcagaaugaaagaccauuugagcacacaggcaucuacucuaaaaccugcaaauaccucagccucaguccucucacggaggacuggggagugugcacucuucuuguugcuuuagaggaggucucugcugcagaagcaggguggguggguagagguuccuacugaaagcuacuuuggguauccagcaccccgggguugguagcaaggagucccuuuaaugaauaaaugaagcuggagcuuuccagauguuucauuaauggggcacccagaaccaaugcugcugcacccgugcccccuacaacuacuaccggcaucugggagcacuuagcucuaaaguagguuagagcuggaguguaacuguaucuaugugaagacugaguuuguauaugggaagcucagcauacagcaaggcccuacgugcuggcuaucacugcaauccaggcaaaggcuuccuggaaggcuaacgaacuauaacuuggcugauaaugccguucguucauggcuucgugagcgcuccagucccgguggccuuggcgagaguuggaguugaguggagacugcagggacggaaacuuuuccagcaagaaagagucccucuucucccacggucacuaaggaggauacuuguauuuuuccaggaucagcugagucgucacaagaggagaguggaggggcaggaggagaccgccucaggcggcgacaagggagcccagcaccuccccugaaguugcagccagcugcuucuuggcuggaaacuuauuuaaguuguccucugucccacuucugaggcucuacagggaugcucugggcacugggauccaugaacaaacagggaugagcggagcgaagggaacacucugcucagaugagucugccucucaacgcccuuugcccucacugugcugguggggagugggggugggggaaucugaugggcaaaagcaaggggcggagaugugacugucacgcagaaggugugcccagcucuuagaaaagugaagaauucaagaaagcaaacacaagcaucucuccugcuucuacucccuaguuaucccaaucccaaugaaucuuggaauaauuuuaguuacugacacuccagauagcaucuucaacagugaagccagaagcagagcaaagggaucuuaguagcauguguuaauuuucaugcaggaugcaaaacaggcauuucaacuuucaucuuucuggaugcagcuacaguggccaccaucccugaccaggacucugucuucaucucauccuucuaacaguuaugcaucaagaguguaucaguaaccauaucaccaugcaggauguguaacuugccucuucucucccguuucaggacagccagccacuggaaagucugaggggcccggcuaacugaaaucugcagauacgcuuaggaaucccucccaaccagccggguuaaccuccauauguuucuaaucucuaacuuguaccccuugugcagccucaaagagauacaugucacuucccgcacugaucugacaacccucucucugagaggcucauaagcacccuuucccaaggauggucacuuacagaaagcugcaggcaaaguaaauccaagucugggcagcauauaauaaauggcuaguggcagauaaugaaaaggcugaaaucacaaaaucaaaauucuuuccaauaaaggugaaucccacaccuauucauuaacaguccccuacugucuaagauguuuguguaagaucaaugaauaagccaugucagaagacuugccgacuauggaaacuauuuggauaaugcuccaaggggcucaggaauaggacagauccaauuuagaacugggggggggggggagggggacacucugucuccaggccaggugaugaagacauacccagggucauucuuucaccaugacaaagacaucuccauuguuucaaagucacuuucagucuccuacaaaguuaucuggagaauagugugccaugugaaugaauguucaaacuuaagcaaggguaccaccuuccuuucagaaacaaccagagaaauacgaaacugccucuggggcaucgcaauaaguagcuggggcugguaagcuccaagucuuaccucugaagucaucaguaagcaugggacagugaaggcucagacauaacaucucauccaaguaaucaagaguaacgccacccaucacagauguacuggugccacccugggcacagugacacaccgagggcacuguauacccuuccugaaggaguuaaucacucaaaugcacaaaccuaaugucacgagagaccccaguuuaagagcagguuauggggucauaggaugagugcucguuaaaagugacaacaccaugcaaaaucagcaagacaagcagacccaucacagccucgagaagaccacacagauaagacacauccacacgaccaaagacuugggaaugaaagaaagcacguuagugggaaaacugguggaauuuaaauaaagccugcuaagaauauugugccaauguuagugucuugguugugauaacuggauuaugauuauguaagauguuaacaugaggagagcugggugacauuucaggaacucucugugccguuuucaacuuuuucuaagguuuuuuuuuuuuuuuuuaaaugaagcugaggaggaagcagagagccugggaggcuggcuuacucuuuaguuugcuuugucacuuugucccugguaaguagggucauuauacuacagagcuggcuuguguuacagcucuuccgauuuugcucccuccaugucuucauaacuuuuggggaaucggauguuacucaggugagacagaagaugagugaagucacaaugucauuggagauuagagagagaaagagagagagacagacagauagacagagagagacagagaacaaacuucaaauuuauaaacacauuauucuuccacaaagguccacaucacacacuccccccauuugugcaccacccuugacaacacagcugugugguucucuagaagauguaguuggaaccaacuuuuagcguccuaaggaaugaugucauccuuugcucuauaggagcugguuccagagguuuuguggaacagcuuucuuuccagaaagcagccaggucugaagcugcucagacuugcucuagacuucuucugucuacagaguacggcaacaucucgucuacagggacugcgacuguuccggcucuuugaucauccuguucccuaaacuuaacuuccuuaaguugcaaaacauuuacucuugguuguuuggguccuuccucgguauagaaauucauauucucuguuucucucucucucucaacggggcuguggacugaacuuacgugaacuucuuguguuugccuggcuuucacugacccuacaccuucaguccuuuuccuuuguacggagaaagaaaucauuaaagagaaaauuguuccuuaaaaucaucccuuuccccauccuccaagccuucuguagaaagugcaguaaugaaaaaaagauguguacucacacuuugcuuguaucagcuauggauggguuccuaccuaucuuauugccaaacugaaaaacuacuuggaaaauguuccaaugggcucgguagaauaauagcuccaagucagaacuggggugcaugggguguguauagucuccagaguggggaaggcuggcuacuugucggguccugcccuaucagccuaccaguuacuacgcugcucuucccuggcagcucagucagugugcggcguggucucuccuccuggccaucuaaaaugucugcaguuauuguaacacaggaugugauuuuuagaucaauauaaaccuggugaacagaucaauccugucccucauaaacacaggcaaguaucuggguaucuagacggucaugaccucuaaccucugaaccaaauucucaacccaaaccaucauuagcagauugagcccaaguaaaugcaugugugcagaaguagagguugacuccuucuuaacugcuagguuuauaccagcuaccuuauggggugccccaaauaccaucuccaacuaaaacccuuucaguuuaaagggcaaagggcccuuagguaaaugguucauuuggugaggccuccucucuuugagcagucacaugaauccacaauggagaaagagacucuaacuccugggauuucugguaaccuaaagaguuccaugucuuuccuacacaauugguccccagacggcucaagucuuauugaaccgauauaucaauucugguggaguuaaaaugcugaguaagagaaaauaaagcugaaguaagcguaaagacaagaguuguuuuguuuuagcuggaacaugauucuuugaugagaaaacucucauaaacaggaaaaagcacauuauugaagcugaaguguuugauggcuuccauuuuccuaagagcauuucgccuuagacacaggugauaacugucaagagcagccagagugauuccucuggauauuucuaccauaaauauuucugagguccuacugugugccagggauuguagugauaguggggauacaaagauaggaguugaggcuauauacacucuuuucaaaggcaaagucucgagcucuaaacgcacgacucaaacacaaaaccaugauaugcaaaggaaacaaaugguuuguuucuuggggacagguugaacaguaaguauggugacagguuuuaauuagaagacuucagaagagcagggcugggccauguaaaucaaauccuauaucagggucuguacuaaacucagaaagacuaacucaggcaguuacuagaguuaucaugauccuacacagaaguucauauaaggacccuaacucugaaagcagagauuuguuguuuuguuuuuuuuggcugccucuagcuagcacauuuaugaaaaacagguuaaguuacuggcuccaaauuacuccuuaauaaaaaaaacaaacaaacaaaacagcauaagcuuuuaagauuuucuuuuuuaaaaccuagaaaacagucucccugucaagagcaggcaugauuaaugacuucugugcuguaagcuuggguauccgccguguuacuagugugugauacuccuaacagcuuguaauugccccgaggauacuuuuggaacugaaagguguggggcggggccuaccuucuuaauaucuccauaauuuuuuggggggggguuagacuacauuuaucaaugggacauugaaaauacagaaacauugucaagucauccacaugaaauuaugaaugcauuaucaucugaagagucauuuccauaaaacggcagaugacaaauagucagcucucaguauccaugggggauggguucaagaucccucccucagacaugaaaaucugagaugagcaaguuucuuauuauagaugguaaaucugcauaugauuuaaguuuuucuuccugcauacuagaaaucagagcuagaugguuugccauacuugagagcgcacaaacgcugcguaaacagucaaccguacggcacugcuuagagcagugguucucaaccuuccuaacgcugcuucucaaaugcugggaauggaagguguguggcaccaugcucagcuagaaucccauuguaaguauggcacuggcuggaccuacaucugcagaacuccaggguacugaagggcuguacugcauccuagcagcuuccuaggucuuaggaagcuaccaaccugcaaacuccuucugaggugaaaccacaacagggcauccaccaaacucaaccacuggaacccaaugaaccagucaaguuaacagaacacugagccaccuuuugugcuccaugacagcccugacagacaacauaggcaagcucuaucacacuguauggcucaaccagccauauuuuccauagaggggaaauggaguuugcugcuuuguuuggcagaugcaaagaguaaaguagaggggaaccaaaugagcuuagagcacuugggaagguaggcugacuuccuaguguguuccacuguaccacgcaaucccacuauuagcuccccacuuccucuggucaacaccagaucugaacgaaaccuacaggaagguuugaagguaccuggccuucuaaauuguggcuuacauaauaacaucaggcccucugguagacccuguaggucaacaaccuaggaagccaauuccuauaguccagcuuaaauaacaaccuuguguuucaagggaaaauaggaagguguggaaagccuccauugacaccccaacuaacuugccuuugcuuuucuagagacaacuaugcacuuaagaaaggcaaucgagaucugcaguuaauuuacagucacugagaugacucaacauacguucauacuaguaguaucuucagcuucuccaguuuuuuuuuuuuaaaguagaaacaaaauguccggccugacauuuuaaaaaccugaccuaugaggaacuugaaauggucaguuuuacaaauuuuccuuccuuuccucucuuucuucuaagucauucacugaauuauguaacugacuccuagaacacacugcagaccccauauggaauaagacagcacaacuccugcaugcaugaucacugcugggcugcaggaauguguuaagacacaugucugucccucaguaguguagacacaaucccugucuugcccuuuagaaguuuauaagaucccugggcacacagaacuugugcaucaaguuaaagacuaaagggccagagugggguugacaagagcaauuucuuaagagucugaagaaagggagccagaaacauggagaaggcagugaagacuauuuucagcagagagaagagagaauguuauugagaugaaaauguggauggcagauuccagugcaaggggugcagaucucauagaaggugggucagggaugugggguuugaaaauggcuaacagcgagcuccauuaugucacagcagagaugacgcaaggagcugucucccagcaggugagaugaugcuggguaggcaggagguagacacaggaaguggauuuaggaacccauagcaaccaugagggagaaugaggguggaacuuaaauaagggagcauuuacguagaaaagaguuggcagaauuaacuccaugggaaacuuaguggaacugaggacaacgugucaacuacaaagaccagaaagcagggcuaguuagauggcugagugaggaagggugcuugcucugacuucaaucuucaggagucacauuccaggcucuaucuccacacgugugcuauggcacguccacacauagagcaaccaaauaaauaaacauaacauugaaagauaccagaaugcaugcugucuuugaaaacccuauucauugucuuaaguauaagaugacagggccauuucccaaaaccauacaucuuguggagacacagguggggcaaaaccaggucaaguucaguggacagcagguaccaaauggacuuauggcuauaccugguaaggcaagccaugaagaugaugaguucuggcucccucguucuucgggaaccugaaaucuggagaagggggaggggggaggaggaggaggaggagaaggggaagagguagugguggucacugguggacagggaagaacaucuaggaggaaagaagcuacagaaguuacugacggcaggagaggguccuuccaggccauggaaacacugggccucaaaggacaggcugcuccagucugaugcugcaucagaaacccacagucaauauauugaagguggaaaucugaaaagcacuuauuuuuauaauuaaauacuuuuaugauagagaaaaaagcaaacagagaaaaaaaagcaaaagcaucagguuucacccaaacacagcaauggucaguuuggguucaucugagaugaccaacaaaugccaauauuagaguuacaguuuuucaaggccauaauugcuacauuuaaaacaucaagagucacagacuguccccaaacagucagagcccucaugaccugccugucccaggaucugagagcuacaguguucugcuucuauuuagagcauuaugaaugcuaaauagaaauguucaaaauauuuuacaaaaugaaaaguagacaucaguccacugcaggucuaaggcuguucuccaacuuuaaaauacauuaguucuuuuuuuuccuuuccccuuuuucuuuucuggagacaaggucucagguagcccaggcuggccuaguauuuuaugugugacugagaaugaccuugagcucccgauucuccugccuccauggaccaacgagugcaguucuuuccccuuaagagucacauaguugaaccaggaaggauggcucaugccugcaaucccagcacucaaaggggaaaggcaggagggcugucuugaguucgaagccagcagggacuauaaagugagcuccaagauaggcugcguugcagaaucacaacacgucucaaacaaacaacguagcagacauaucuaacccuuaagcaugacaacgacacauuuguaugauaccugaauaauaagaagggggugcaucauuauaauuauuauuauuuuacaguuguaaacaugggaaagugcugagcaguucaaugagcuuagggcuacagucacucaacugcaugcuagcucagaugaggauaaugcagaaacgccugccgggaggaaggaaggagcaaacacuucugccacuccgugaaaugucacucaaauaacaaaacaaacccaccgaccgaccucucaggauaaggaaguguagcggagugggaacacacucuugacuggugugugaggggcccugggauucuguaccuagcaucacacacaaaaacugcaaacaaauucuuuaagccaugcuugguaaaaaugacucauuuugaaccuagugugaauuggagauuauuuuucaauuaaugaaguuuuucuaguuggaaggacuuacaacaagggccacuaucccaaaagcccuuagggacuugucuaaaugaguaaaaauauugugcaauuaggccaacaacugaaacuaagugcgucugagagcuuaaaaguagucguucucaaguacuaguucgaagagcaucaaaucauauaaaagguucaaaggaauuuaagugaacuggguugacuuuucaaggcacugagguaauuacaaaauacacuaaauagcaaauauuaggcauacccuagguuuagacaaacaaaaccacccuaaaaccgccagaucauauagacacacacacacacacacacacucauuuucucucucucucuaacacacacacacacaaaacacauuaggguaaauauguauuagaaaaaccuuugccuaagauuuccuuuaaacaguggguauuauucauuuuuguuuuuuucuuuacagaacauuaauuucuuugcaaaauguuugggguacagagauugccugacaagaguggccaccaugaagcuuaugggcacgugagaggagaggugaagaagccucaaucuuucugagcccauuucaucuccccuauuauucuccacgauuuucaaaagccacucuacuacaaaccugagaaacacaggaggucagauucacaaaugaaaucucuuugucucccuucuguaugcacccagcaucugcuccaccuagcugaccguuacaggggcagggccaguguuaacaugucaagugggcagagggcucucugcaucuccuaguacauuucuggcuacaggugaacuaaaugacaccaaagaacugcucucaaacgugcaucccaagguagagcuacaaagguucaauauaaccccaguauuuugagagaucuuaaaacgcagucaaaguuaacugucauguccauagcaaggaggaacucacuccuuaggauacacugggcuggucuuccagugggcauuucagagagcccugcuuucccauaucagcuccauccuguauccucaccguugcuuccaacagggaaccguccacaucugacugcccaaucagauuucagcagguggcaugggggauccagaaagcauuucucugcaccuuuuaacucugaacugcaugcagaacccgugguaagaaaugcuucucugaucgcuccuagcacuuuuaguggccauguuaaaucagcuaaguaagaaugacucuuccaucuguguuaaguggccuuuuaaagcuaauucacacuaucuccaaauacccugaauuaccaagucugagggcugccuagauuccugcuuguaagcaauagaaugacacugaggacucucggcucucuucucucucccauauccucucugguucacugagaaccaaacaucaucuaaacagaacaaaaacaucagaacugaaggaaucgccaaaguauauacacgugacucccgucugaaugcauucagauccgaccagugacuccaagcuuucugcauguuucccaugagcuauuugcccugaaucaacuccucaccacaacucucgaaaugacauggaccucugcuguugcacuuauuauuccuucucugauggggagugguuaugacugaaaauuuucgcgcaaccagccucuaaacagaaaugcaguuuauucugaguacucaaauucaaaucucaguaacacagcaauuacauuuuaaaauaaauucucuccauguucuugcuucuaagaagaggguuuagugggauaugaagagucuaauccuaggcaaccauauggccaggccaauuauaaaccccauauauguucacacaucaagcagggcaaacugcucugggaacaacccuuaauauuuuauugccugcccaggugccugagcacuucugagauacaccugucacaggaaaauacagcacuuccuuccaucuuuaccccauaguugccagacaauugggcagagcuaaaguggguaauguugcagucaacacuucccuaaaacauuuauacaugccacugauaaacaauagaaauuuaaaggagauacaaauguacuccccaaacccuaaaucuuccucccacggaggccuaaaaacuuaaaaaucuucaucuaccuggcacagaagaaggaauacaaauuccaaggggagccuagauuuauggccuaaauaugucuuccucuagaauauuuaauacacuuacgcuuuagucauuccauacauuuugaaaauacucuagcacgauaaauuacaguagcugcaucuuucaugguuguucacauaaauaucauuuggcuuucaggaaaccaauuacggagcgguaaaucauuuuuacauugcuuuucaaaaucuuuaauuuaacuugcaacacggacagggcacacacaggcucccaggaagaacgcagcucacacauuguaucauucccucuuguccgaguuuagcaacaaccccugaguaagccacaacaauauuuucauguucuaaaauauuuggguuauaucuauauauuucacacagguauuaggcucagcaaguauuuccuaaccuccuguaguauuuaguuuucaagacuugggguaggauugggaccacauugauuucagggugcugacuguacuucugucaccaucagcuaguuuaaggacaaugacuguccuggcagacaccgcaaacacagagccucuaugguguucuugagaaaucaagaccaucaucucauuggaaaggcggugggaaacaaggugcagggccauugaggccacacaaucaacaacaggauuugcuccagccucagagacacagaguggacuggcauacuauaucaauuuggaauccccucggcuaugacaaguuugugaaaugaaagaacaaaacaauacaguacaagaucaaguuuuaguagagagaaugcagacaaccacaaccgaguacuuagggagaaaaaaaaaaaacccagcucuuagcuggggagugacagucaaggggggaaaucacgcgaaggaauuucuuucaggugcaagaaggcaugagagugggagacaaggauugagcaucuuggcagaaggaucagaaacccaguccaaggucuacacuuccguggagcagccgcagacaagcuuagguauccgguggggauaaccuacaguuaagacaucacauuacagacacuagggagccauugugaauuacagccaacaggugagaaucauaacuuagcggggcggacacaacaaccaagccgugaucuagagcaggaagcgggggauagacagaaagacagguuguaauggaggagaccaagcagagggcugcauuaaggcagaggcuucugugcugaccaagugacuaacacaaagggcccuugcagaagaccagagaugucaggggggagaauuccuucugagggggccuaguuacacuagccacuugauauucaccgggaaggaggcagagaagcuaggagggugggcacaaaggcaguggcucucuucuaccugaggagagcuggcagcucuaucaauacggacuacuccuaaaugggcugcagucagcccagaaaaaaaaaaaaucacucaauacucucagguuaccuacccuggcucccaaagcugguuaugcaagaaauauuuuguuguuguuuugcuuuuaaaaggagacaacugaugcuuguuuuaguauuguuugaacuacaucacucacaaaugagagacugauaaagagauugacaagucugacucuagaagcaaacacuuccagucugcucucaucugcccucccccacuuccuccauucuccucggccucuaccccacaauaugcuugaaaauaguagguaacugaguuuguuuuguacggugguugucuuguuauuucaagcagggugguccagagagaaaaaaacauuuucuggaaagauuuuaacuacuggaucauaaacaagcgugugguggccacgcagcaaucuuuguaauaacgaauccaagacguccugguugugaagcccagugaauguaauguuagcugaaaagcaccgccugacacaccuggaaaugugccacgggccagcuuuguagacugcgacuucaaagggaaacuggagucuacuuccgcuuuucagugaguuagaaaugauuuuggcuguauugguagggcagaaccagaaaauaaguuuugaauuugucauaauaauuuacaaaaaccaaccaacuuguuaagaugcauccuccaagcacaacuaagcuggcuauagaggcuauucugcauucugcaucugguccccuggacugcucaggcuuagggugagggaagaaacaugacuuaagccauuacccuuauucugugggcauuugaaguggcugccaggcacgugacaccaacuguuccaauugguucacaaugacaucacuuuauuauucaacucuguuugcauuucagucuccuccuuuuucgggggacuugaggccaauccuggccaagucacuuuagaagagaaagaagccagucuuagguagucaugaagugccaagugucuuuugugucuccuagccuaguuuguaagccgggaacuggugacauaaagggcucugucaacagcgcccgggugugcugcuucccucgcagcgggagagggagauugggaacccaguagaagguggcgguucggccuuggguaggucccaacugaccaaguucaauaaaaucccugagaguuuguuuucaauuggguaagaaaacuauaaaauggaaaccgcaugcgagcuuacgcuggaaccucauuuaaagcacuuguacuuccaaaaaaaaaaaaaaaaaugcagaaaacauuucuaauuuagucaagcgcacucuucuuuccucgagcaauuagucuuaauucaugucaccuaacuacuauuucugcauuaagcaacgugaccucuagaaccuacaguaacccccuuucugauggugaaagucaauuauucugauuuuuuucaucuucacacaauaaguuaccagagaauaaacuaacuucaaaaaagcauuacagugucauguguguucgccuguugauaugugcacacauucauggcaccugugggucuguauccagcucuucuacugugccugucucucaauuuugcagcucaaccuagagaucaccaaguggccagcgagcuccauggaucagcccguuucugcccuccucuguacuaagauuacacgcaaucaugcugagccucuaagaacauggccgcucauggucugaacucggauccuccaccuagcauggcaaacauguuaggaacggggccauuuccucaacacaaaggaaaaaggcuuccucaugggagagaaugacuggaugggcgaguagacagaugaaaauggacuuuucacaccaacugguuagagacccuguugcuuccaggcacaaagcacaccaguuucuaguaucaguggguugaaaugcauguuuaagcucucucauccuuacuuggcucuugacaggaaacuuuuaugguugaacuuuauucuguagaaaugcaguggcauuaaccaagcacacaaagccaacucaagccuaaagugugcccaugacuccaacccuacacucauugguucuugccagaggcaacacgaaacaguguauagacucagaacucugcccaggccugugaggcagggccagggcuacacaccuugcaaacacacagcaggcucugcccaaggagcguucacuagguaacuaucaggguggcucaagggcuguacgacagacagacccugcacaggcagggaaaguuuccuggagaccuaccaucuauuuucuuguaaucucaacugauguguucugccaagucaacuauuauuuaucauuuauaaagcagcuccuauuggcagcauacucugcauauguuucagcacuucauaaacccuccacgguauaaucgcuuguggaggagacuggguugccuggagcuggaauacagacccacacgcaugugagcccguguaaaugcacacaugaccguucccuaccgcucuuucacgagucaugucuuggcucuguaggccgaguaucuauaacuaaagcucucuacaggugucaaaucaagcaaucuugguccucucagaugucagcuaauggcuuagagcccccccccccuaacaguucuauuugcauugcuaaccaaggcuauccaccuuaguaucaucaucagugcaagagaagccaaacugcacacgaagaccuggagagcacuucagagcacacauccgaccucuuccucauccgaguaccuagcaagccaguuuuccuuccucuccugucuccagaagaaguuccaacuccaccucggagcaaagcagcagcugcagugacuagcagugacuaugccuuugugacugcguaucacucauccaauucacagacuacuuagcaucgacuuguauacacuuugcccaagaauaaauauuuauauucccgaaacacagucgaucgagagcagcugauacagggcuggagaugacagaggcagcaaacacaaacaaguaagaccuccaggagugugagggacagggcuagagacaaaguaaacagaggccacaagauccuaggcgcuaggugggggcuacugguacguaagggcugcuggaaagaagaguccuccggggacuggcucccacaaaggcugcccaaucucaaguggucagcucugggcgcuugucuagauggcaaugcugcguggacucaguggguuauguaugcguguguacaugcacaugcuaggauaauaauuaaaaauaagaggucaugaguuugggagguuggaguuugcucaugggagcaacuggaaguggggggcagagaaagggcugggagugacacagguguaguucuuguguauggucuaaagauuaaauuagaguuagggaaaaaaaaaccccacaggaauugggaagagugauucccaagccacugacacagcacagcacugcuugccuguggaggugcuccugugccauccucccuaaucuuuauguugcacaucuuaagaguggucuguuuguguauccucucaugcauguaucuccucagcguucucauccacgaaugcuuacaggugacguuagcaucagcaguuggagaacaagauacacuggaaagaaaacauuguacccugauuugcaccgggaagaggagaaagggaacacgcuaagcauauaaacauguuaacggucaaguagaguccaaaucagaucuugccacucuucaaacugaaggucugugauacuuaaaagggggaaaaaacccauugaaaugcagaaggcagagaccaucacucaaagauacucaucgcuuggaggucaguuuauauuuggaacagugacuugggauuggccaaccaucacucaugccauuaaaguaauauuucaguuucaacuguuuuacaugcauuuagcauguagacguauucaauuuauaguuguaaacggucuacaaguguaagaagccgauacccaagcuucgaauuuguagguguuuaagucuaagucccaauucauaccggcacuacaggucagcaaguguaugguuuuuaacuuuaagagggcgcucaauaaacucggauagaaaaucugggagcaccaggccuuguugugaagcuacuuucaaggcgaugauccucaucgccaggaggaaguugguuuauacccaucauaguuccuuuaacacaagcaaugcagaauggccuucacaagugucuccucuaaaaugacuguuuaaauuguguuguuucaaaaagaggacauccacgagccgcauguuuccauuaucccuuggaacuggagcuacaggcagucaagggcuuccuuacuugggugcugggacacaacucuggcccucaugguagaacagcaagcccagcaaccuuucuaguuccaggauuaggucuuaacuuucguggucucuugauggcacacagaaauugucuagaagucagaggcuauguacggguggaugauguacacccagucgcccuccaagcaagccaaauaugaaagcaauuuuuuuuuucaaaaauaaaauagcaccacacugcucucccaccaggcguguagagauuuuccccaacaaaauaugacacacaucauaucuaugauugcuucuaaaugaagaagucuuuaaaaguuuuaacuucuuaagggccaaauaucaauggauauauuccauauaaauaaaaauucaucagauuugucuucaccuauuuugguugcuguaaccaaauccaucaaccaaccaacuaaccaaccaaucaaccaaccaaccaaccaaccaaccaaccaaccaaccaaccagguagucucugucuuguuccagucccauuuuccuggugcacaaaaggacugauuuuacuuguuagaagguuaucgggcaauucucugugucucucuuacaaggguacuaagcauucucaggaggguucaaucuuuauggcccaaucacuccccuucgccccaaaacaaugucuugaugaccuuccaacacagucauggcagauuauggucuguaggcuuuacuggugccaagggcuccugagaauacaacaccaaagugaucucaucccaagaaggaugcuucagacagacagucccacaugcuuuccucuacuccuggcucauccccuguauuccauacaucuauaucccccgucccucuuagcucuccucugaguggcaaagaggcaucuccgacuuaacgagaugcaaggcagaguucuagcuccaucugccauccccaccacacaccucccaaacaaaccuacucccuuccuccugccagcucgggaacgggcaacuucacuucucguuucaucuaagccaaaugccugaaucauccuuuaucccucuuugccccaccugcaagauuucacaagucccuaaauauuccugaaucuaucuacucuuaguuacuguaacugaugggugcaguucucaacaaggaacucuucugucccggcacuaccugcauccagccaugucuagauacauuuuucaauugugucugcguagacaagggguagauguaccaccaguaucuagcaggaagaugcauagacaagggguagauguaccaccaguaucuagcaggaagaggccagggauauugauagacauucuauaaugcacacagcagcuccuaucaucaaagacuguccagcucaaaaugucaauggcauugagaaacugagcucuauuccaagccaguagaaucucuccaaaaaaaccuucucaaaacaacuuccuaacuguuuucccugauuuuucacucuuaauugcucugcucgaugaaaacaacuaaaguuaucagcagaaauacagagugugacccacuagagugcuuugucuugugucauggccuguaggcccuugccuacuccacuggcccccggccagcuccuacauucucaucccaccaaauuccuacgucagagcccuaagcccucaggugacucugcuagagacagacucuacgguaguaacugaagguuaagugagcccguaaggaggaacugagccuuguaaugguuggugccuucaugaaagacacacggaagcuugcucucucauccacucugcugugaagcuugcucucccauccacucugcugugagaagauggccauccacacagaaaaaggaccucacuggaauuugaccuugcuggaacucugaucuuggccucauaguucuaggacuuugagaaaagaaacgucagcagcuuaagccacccaggcugugguacuuuguugugaaagcuuggacuaauacauucaaccuugcuaccuugccaaguuccaguucacuggccaucaguccacuuacaccacagcccuugcccucccucuucugaacugccauuagcugaccccuaauaaccccuagucaaaaugccacccuccccaggagggacuguguuacuccauccuuccuggauuuugaggacagccccaugguuggcauuaaccaagcugccuacccucuuugcuuacuggucuccuugacccagugcagaaaccucucagucuugccccuugucgaaucaggauaagauaaucuguguggcuuauaucucuuaaacucaaaacaaggaaagguagggggucugugaacaugcuuugccccaugacccaguucccucugccgcuucuccaaagagagcuaccauacuuaugccuaccuuaguuucccaagagcccauccagggcaggagggaaucauuacauguaacaucuagaaugaguacuuccuuauauucuuucacuuuagggagcagcaaagguucaagguuacgguaaaguacagguaugggggcaucacccugauaugaugaagcaccaaggaacuccccaauguuaacuaucuagccacagagcagguaaggguaugcuccaguuaguuuuacgaggucaacucugaacagaggaaacaaaagcaagcaguaaaggacuaugaggcacguggguuugugcuguguacagccgagcagucacagaugccucacuaaggagguggcauggggacuaagagugacuggaguuagccaugggaaauucaggcaaaaagcaaggaaggucucucugaacuggugaggaacagcagucgucagucaguauuacuguccguuauuucucuacacuggccccaggcaggugcuuuugaaugacuggcuguuugcaaagggaaguccagauacagauggccgaaugaggggccacgagccugugcaggacauacagauaauggaacaggaaccuugcaaugcugagaccuacuacgugacgggugcuuaacagcuuuugagguuaacggugggaauuucugagagaaucccaaagagagcuagcugguugcuugaggccaacaagggcaaggcuuauaagucaggggcaccccagaaaggaggcacaccccagaaaggaggcagcuucuaagaaagaggaaaagagagaaagcaggcaagccugagaaaucaggcuuggguggccugaaaaggcagaccaugauguguguggugggaaagcagggcaggacuccuccuccuucuggaggaauacaugugcuggcacugggacauccagcuucaaccccaggagcccaggcccagcaugaccuccuaacgcacuguuuaguagacaggguagagccuuuaagaaugguggcucgauggaggcccugucccauccuccaagaugucuaaagggggugggacuggcuaagucccuccuucucuuccucacccccuccacauccaaccuccuccaaaaacaucaaauauuuucuuccauaaauaauugcaacaggaugccauugcuuuccucaaagaaacaauggccugauugugcccuguccgacacgggcccagccccagcacacacaaaggguggcuuucagaagcccugcuguagagaauggggguacaccuccuuucuucucuucuguaccaaguccacugcccuccaccaggaaaggacaucaggaaggggcugcuaccacaggaauaauucccaucagaggacagcuaucauucaccugccuuuagauugcccuuuggccaccucuagaaaguucuucguucuggugaacagaagagcaccuauuggcucuaaaauccaacacacacacacauacaguuuuaggcuggagauaucuauaauuuuuuuuucuaauuuucaaacuuauuugaaauugucauuaauuaacuuuuaaaauauuugaaauccuagcauucaggaggcagaggcuggacaauugccccacauuugaggccagucugguauacacugcaaguuuaggucagccaggccuauguagugagcuccugucucaaaaaaaaaauacauaaguaaauaaaaauuauaaauagauaauaaaauagucccauuuuacguguacaucuucaguuucacaauuugagauaaagugaauacagauauuuucauucaguaucugugguagugccaacacuggaugcucacacaggcucaugcaugugaacaucugguccccguggcuggcacaguuugggaagguuauggaaccuuuaggagguggagucuugcuggaagaagugagcuaagccacugggugcagacucggaggcugauagcugggccccacuuccuguccgcucuccuguuucuucaccccacuccacuuccuaaguacaggaagcgcuucaucuagcuuccugccccugccaccacagcaucccagauuaauuccauggaaacucuaagucaaaauaagcccuuuauuacuuaaguuguuuuuguaacacuaaucaaguguguuucuugguuaaaaaggacaggcuggacuaaaggauucaauuucagcacuuaaggggcuggagagaugagagagccugcugcuggggcugugggcugggauaaguugaggcccgaguuuaguucucagcacccauguuugguucccaacauuccauguucaccccaggccuccaagggccuccacacacauagauauacccacccugagauauucgcaugcauauaaauaaacauaaaauaaauauuuaaagaacccaucacuuugcagccauggcuugacaaacaggcucuuuggugucuuccucacauaggugcaagaggaacucaggcagggguguugaguuuuuggauuuugcacuuauuuauuuauuuauuggugguacucucuguuuauugggggaguugugguggguugccauuuguaacauuuccauuaaagauguuaaaaggcugccuucccauuuucaaagacucagacugaucacucucccagccagaggcuucugucagcuacuaaaggguuccuuucccuucuauuuuauggccuuucucccauccacuucugcuuuguucuuuuaauuaaaaugaaauguaggcccuccauggcugagaugcuaauaaggccccugaaagucaucugugagcacauccacucuuguuuaaagagccauguaaacagaccacagacggcuacagagagcaacgcugcacagggcaaggaaaagggaaucuggcugcaccguacagugcuacguugaagugauuuaucacuuaugccaggaggaggaacugaaacacaaacgcaauuucaaguuuaagcauggcgucuccacaggaucuuccauagcaagcacucugcacucgggggcucccugucaggaaacuccuggacaacgguugguuugccgucugauccacuucaguuaccucaccaaacauucaagagguacuuucugaugugugugggcuuuagcgcuagguugauacaaaacaguaccuggaucuguacuggaagucaacuauauuugcugccaaauccauuguaacuggcucugcauggagccauccgugugagagaggcugaugugucugccaccacucugcagacacuggaaacagcgcaggaccaaucuguauccaucguuccuaccuguuucucaguggguaacauucucaaagcauuuucagaugaagaauuuagucagacagacagacagauggagacacggaucacuggaagacugcuguauggggccacauggggaaacacuggguuagucaggaagacacggcgguuucuacagggaaagucugggugucccuuuggaguucuugugugagaaaguuguccccaagguaucagugcugggagauacaaguuuuuuggguuuuuuuguuuguuuguuugcuuguuuguuuguuuguuucaagacaggguuucucuguguagcucuggcuguccuggaacucacuuuguagaccaggcuggccucgaacucagaaauccgccugucucugccuccugagugcugggauuaaaggcgugcgccaccacgcccaggugggagauacaaguuuuaagaggugggccuggugauagguucuuaggccacuggguacccuguccucagagauuaagguaauucucacaagagggcuagagaaacgggccaagugugaccucucuccacaucugcuucuuauguuuacuugcucucagguuccugucacugacucgagcaagagcaacccuuaccauagcugcacuaugauguuuggacuucaaaaccaaacucuggacauuaacuaagauuucucuuuuuaaaaucaguaauacacuguugacuaacaaugaaugaaugaagcagaguaaguaggcugaggauggacugguucaaguuaucuuggcaggcagugaaguuggguaguguacggcuucccuggcauguggcccuagggagaccaggacagaagaauauugacgcagagugugagaggccaaucaaggaagugugggggcugagauaugugcuucuuuacuaccuaggaaucuacgagaaucucuucaggcucagucgaggccccccaaacggcaagccugucuaaguacaggaaacaggcaagauuaauauggaauaguggcgcaaaccaauuagcucaaaaauuuccacaaccccauguauuagcccucugcucagcucagggagauaaugagaacacauaacggaagcucccaguucaccaaugcaacuggggagcggggggggauggguaccucaaccacucuuaaugagucuguagacuaagauaacagaauggcagucuuccaucaacaugagguaaagcuagcauggcaccucagccuuucaaaguuacuguucacugaaauguuauuagaaaaauugccaauugugauaaagccuauggaucaaacacuacucccauugcaaggaacauucauaaacagaaagcuguugucaguccccgaaacuuaaacuguauagagcagagaaaaccuggaagagggaagcgccauaauacggaugagaaaacagggcuaggggcucguaaauggcagaucaggaaggaaucccauccgccuuggaguuggugaucuuguaauguucagagaauggacucauuucaacucacagguucggugugacccacgugcuugcugaagcaccgugcuuacuguauggugcuacacaagugaggucucucauaagcugcagagacacagaaaagucucaagggacaggugggugcauguguccaagaccuggucgagcaguuaauacguccagguuguggcuugugcucugcuucauuaguguguugccagcgacuaggaaugugacggcuaccaccuugcuguuuggacucauuucaugggguaacugcagcaggcacagggaaugagcuaagacagacccugggugagggaggcagcucaucuucaaugcccggagagcacaaccuaucugaucugauauacucuccaguuuacaaacuacugacaaucacaucaagugaagggcagcugcagccacagcucucccuuguucacaguuugcuuuccuugguucuaguuaccugaaggcaacuaugacauaacaauauuaaauggaaaauuacagaaauaaaguaguuccuuggccucaaguugccugccacuggaaguuacaggaagccaucuuguuguccugcucuguaaggguccucccuuucugcaacggauccaggcuguauacccaaccaucggcuagcgacgucauagagaucugaguagaacaagugcuguuguucaaguaccccugacuuuacuuaacagugacccccaaacgggaaaaagaguaguguuggcaacuuauuacagccaaaaacauguuauuacaauguauuuuuaugacugcuguauugauacuguuaauugcugguuauaauuaagcuucguuauagauacguauuuauaggaauuagcagcauacaucagguuuggugguauuuaugguuucaggaaucuacuacagaucuuugaaaguaucucccucacagggagagagacuacuguaccauugcucuucaauggugacuccuaauacuggcauauagacagcucugcugaccuuuuagaagugccagagaacaggcacucuggacacagcgcugcucuuggccucgagggaucugcaagaaggaauggagggaaggauaugucucuggggaccagcuucuccuuugaacaugcaggaacuaaugagacgcuuuuugaaggaguccaggugagugacaccuauuaaaggugcuuaguuaaugcucauccccauaaacgcccauuacggcgacagguucccacuacucagccggaacguuugagcucuagaugcuccucugaagaaauggcugaaaaaucagggagagaugcuaaacccaaacacaguagcagugcuggcaggagaugagccaggcuggugagcuguucguaaaccagcuguccccgcccccaagacuggagaguacagagaauuccaugcacccagggucgucuuaagacaugaacaugcuuucagagcugcaucccuaagaaacuccuacaaaccugcuccagaccaugacccugcaggcucugucucaccccugcccuuccacucagcugcuccugaguuacagccuggcuaaaauagcaaugcuacauuuucugccauuugggggccacugaggcaaaugaucauguugaagggguaacuggcuauucacucaaaccucugcauuccucagugagaggacagucucagaggaucccaccaggaugugcuggcucugcauggugggugucagaacuacauucgauuugcagguaccauaugguguuugcggggcuggaacccugcuuguggguauugaaaaucacguacugggagucaggagcguugugaguacaaacauuucagaguguugagagugcuugguggggguuuaggaacaaggcaggcucugacuuaccagaacugcagcuuuuauucugaaguuucuuuuaagaaccaagauuaggggcuggagagauggcucagagguuaagagcacccgacugcucuuccgaagguccugaguucaaaucccagcaaccacaugguggcucacaaccaucuguaaugagaucugacucccucuucuggggugucugaagacagcuacggcguacuuacauagaauaaauaaauaaauaaaucuuuaaaaaaagaaaaaaaggaaccaagauuaggcauuugauucauuaaacaggacaggggaucaaauaccuccguugggcucucgagaacaugacaggguggggugugcagauaagaaggcucuagcuaggguagcuggaaucccucuuucaacgauggcgaagcacuggcacccguagaaagaaggaaugauacgaaucagcccacuauucugaacuaugucccugcccagacacagaggcacaugcugggccugcagcaaauagcccuggagccacacucgugguuggcgugcagaggaggaaccaacccaucagaacucuguccguguggguguguguaggugccuguggugaaggucagaggucaacucagguguccaauccaggcuccuuuugaacuucuagcuuaguuugucaacacuggcagcugaauuggguuuguuuguuuguuuuuugagaugugaucuugaucugcagcccaggcugggcuugaauucauucauguaggccaggcuggcucacaguaauccuuccugccccaguuuccucgggacaaggauuauaaucugccagggaccaccacauuguggcggcauguaaauuuuaaacguugacaaagcauuauccuguauuuaucugagaaugccauuuguuucaaaaguucucugcagcucaccaauucuuccaacagauggauuaggaacuacacucuaaaugucucaaaucacauaccacaaucaaaauucuguggcuguaugugugccccgaccccuaccucuccccgagccuccccuccccagcccagguuuaaccuggagugcuuucaccccugcaucagucuugacgcucauucagcaagaaaaucacaguccuuccugcaaagcuccuguguuucuccuucgacucuauccgggccuucuguuuccuucuguaguccucacauagccucagagagcuggcguguggaacagcauucagaaauagaagacucucuuacaaaaucaaacagcauuggcccagcugcccauguaugacauucuagcgcuucagugaggcaggcuuuguaagauuccugcacauaagcaauaauguaauggaugugugcaccaggcuguuuguuuccuuacuguacuuacaucucuuccaaugauuaaauacaagcccugccugguucguucauggcuguagaauauaaauauguuucuggggcucaaacauuuuaaauuaccuucaaguuucugaauccggcuuuuaaaaauccucaaaaaaaccccaaaacagcaggaagccacuuuuucauuguguuucaagucagcuacaauuaaaauaucauuagcuccaugacaagcuaaaaugcaaacaaacaauuaccgacagaacauuacauauuacauuuacuucucauuuucauuaguacaauuccuaucugggaaaacauaaggagucaugggguggcaaaguaagacagaggagccaggauucugaaggaguugaacaacucacgaaagagcacuaacacacaaggagagacuuaaccguuagcaggaucucccauuuguguccauauccaagugauggacaggguucuagugucucagccaccaaaugccuggcaccugaugcccacuuaaaagcaacaaugagagucuucugcccuuggugggugaaaaugcuauaaacaaguuuacugagagacagccuaggaucgggacucacggugccaggaugccacaggaacagacacaaugcauuacauacaagcacacacagaugcccaauccucuuuaacaaaaccaauucucaugugccaacagguuccacggcuucagacuuuguaauagugcccuguauuacgaagaaaauggugcguuauuaauuaaugaagaucugucgguaacaguugagaagaaaggcuuauauuuauuaaacugagauguaagcuucaauuauuuggaaaaaaucaacucgaggggaaaaaaaaaaagaaacccaaagccuguuucaaugaugcuaaauaaauacaauacacaugcgcauguuugcacacacugacguacaacuggaugcuaauugagaugugaacucaaugacuuccauggagcuagauuuaaaguguguauacugcuuacuccacauccacaaagcagcuguuggucacaacgucucugaaacccucccaguucuuaacaauucuggcucucuugauaucacccccaaaaucaagugaacacagcucugcucuucaguucucagucccaccucaucagcccucuuccacgcuacagugggcugaccucugcugagaccccgaccgcugggcaaugcagggccuucuccuucugcccagcuuuuccacucugcauguuucacuuccucuccuuguaugacagugcucugcuguaggaccucugauagccaacagaauccugggcaaaaaguacaaagcuuaaaaacaucacccagcuucaaaguacacugcaaagguggagccaggaggauaauagagaguuuaaggccagccuaggcuauaugagacacagucucaaaaacaacuguaaaagugccccaaaagaaaguucuacaagugcauguuuguuacaaugcuacaguaaccuaaagaauaugguacugacagaaaaacagacaccuagacugguuacagaauaaacagagaaaagaaaaaaaaaaucaacauauuuccaaucaaccaguauuugauaaaagcccugaggauauggauauggauauccauguacgcacacacucacucacauacacacacacuuuuauaaccuauucaaaggcaaaacauuuaugaccagaaauuacaagacuacuuacaagaaaccauaggggaaguauucaugaacuugcucugucaguuguaaggguuagaaccuuguauuagaaucaccagccacauccugcugucaacucauuccagcuauuccagcccagauguucacucuagguuuuaggaagcauggaacuagagagauggcucagugguuaagagcacugacugcccuuccugaaguccugaguucaauucccagaagccaaaugguggcucacaaccaucuguaaugggauccaaugcucucuucugauguuucugaagacagcaauaguauacucgaauacauaaaauaaguaacucuuaagaaaacagcagcagcagcagcaugcuagaguucauauacacugucugccuacaguucacccugcuaggacacuggcaagaauggugggcauacacacucacauuuuccagaaaguucaacuagccaggaagacucaagauuaucaagucgacauaucauucccuuucagacagcccgcaccuauagugagauggcucacaacuaccccaccauacaccccaccuuucccacaagaaaaccuaagaacaacuuagauguggcauuaagggcuugaaaaggucaaagccagggucacuucuuccaccagcaucuaauaucugucuuacagaauggaguccuuaacuugugauugaacaacuguaagucucucuaacauacacauacauacacacagacagugcugguaauaacaucucauagagaaugcccuuucccaaacacguggucauggacacaaaccagacaucacugccugagcauggcaaagauggucagcaucagaucugugccgugaaugccaguggucugucuccaugcccaggacggucucuuugugaggcaaugcggcccaguguugggcucacucaggcagcuguaagcaggcugccgcuuccuauggguguuuguuuugacuuaugcucaggacaauggcuggucuuuuuguucauccccuagcaggaaguggugguggggagaggaccagcccuugucacacacuuuccaauucagauuuuagucgccacaaaaaaaaaaaaauggggccuuaaaugcuacagauaaagaaaugccagugcaggauagggaagcaagccaagaaugcaggguaagaaggcacauucagaucugggcaggccucagggagguaucaccuugccaaaagcacuccacucuuguggcucccaaaggucugaaggcugaguaaagagacugcaaggcuucuccucuuagauagcacagggacagaggaguaaccaagaucccaggaggugacaaggccgcuccccuucuuaaucaaccuuuccuacuauuucacccaauuaaauugagcaaaugcucagaacacaagcuuuaauguugaagccuaguguuugaacacacuaaguccaggaaggaguggggggcgggcggggggggggggcuaaucugaacugucaaauaaacaagucauuuccuuuaaaauaaaagccuggacuggauggcugcaagugaaugaauuguauuacccaacggcugguguaaugcaagccuucuccucccccuucugggccucauucauaaaaagaccaagcagcugcagggacugggacuggguuuguggccgccguauuuucuaagacagaucgaaaacaagcgaaacaaagagaagugcucagacaccagcucggccucugcguccugugcgaagcuugcaggggccucuggggcagcuggucucuuacucaagccaagcccaggcuacucgggcauuucucagagcugcuugccugucugggcgguucuaacacuaacacgaacaccaacaccuacuguguuauuaaaggaacuccuaucugcugauacacuuuuccuucccugacauuuuauuaaaaaauucuuagaaagacaggggcugucagcuuauuacagguugccaaacugcauugaaggagacaauauauuucccaaaagauacauuuuuaaaauauuggcuguuuuuauguugauaucacuacaucuaaaccuucuacaggcuguuaaaaaucugagaagcuaaggaguaaucucaauucuuaauuuuuuuucccccuaauggcaaucaccauguucccucuggacuacagauccacccccaaagcccacgcuuauuuauauggcaaacccucacagccuggcuuuugcuuccuccacaaccaggggaggcuguuguuuuuuguauguauguaugcauguauguauauauguauguauguauugacuaggaaguaccaagcccuaaggauggucaggaauucccaugguuaaucagucuaucaauuaauuaaaccuaguauucuguccuaccuugaaacaggccuaaauacaaauacccauuuucuggauucguguuaauggaaggagacacgagaggggggggaggagagagagagagagggaagagaggagagagaggagagagagggagagagagggagagagaggggggaggggggggggagagagagagagaaugagaaugaaugaauaugaaugaguguaggaaagcaugcuacauuuccagaacagucuaccucuaacaccgccaacccacucugccccacagugcugggaucaagugggcauguuucucaaagcauggagauuaacuccucagccccauguuucuauccugacugaaggccuaagcaacaagaaaguaaccaggagauaucaaauagaucuuguagaauacaugucugugauuaaauugcaauaauucuauaacuucuucaaaggcaaaaauaucaagauaacgagcugaggaaaaauaaaauaaacaagucuuacaggaauuaugccagguuuuauaaggaacuagaccagagccugaagcaguuuggaguuuuguuuugaaacuugucucugaccugcuggcuguccuuuaagagugcucguggagaccuguugacucuguggccaugaacauacuuucuagguaaaggaaacaaguaccuaugauguugucuacgaauuacucuuuggauucaggcucagcagauuuuaaagcacaaauaaccugaacuccugguuaaacauccuguguuaacgagcaacacauuccuuaaacaguguggaguguggccacagucaccugaagauauaaaaacuucccucaggaacaaaaaguagcauccagacugggacaugcaaaaucuacuucccccuggccuauucaggguccauuccacauguuaguacacucuucuccuaacucuuagaacuaccacccugaccuaagacuuauuucugcccuacaggugggcugcagccuccucccagaagcccccucccaagaucaacaguuuucuuuuccagggagcacacgguauaacucagaaccuacuaucuccucuucaguggccaaggcaaguccaccauaucagggcuccacacaauuggcuuugccuucuccaugacucucgggacacaggccuuuuaacaucucccuuuccuaugccucuucuaaagauccuuugucucuucucugaagucucugccuaaacagacacuagacacucucuaaacaucauccauacaugagcagcucgccuccugccacguaccccacugucccuggcacugggaagagugccuggcgcagacaggugcucaauaaauauuuguggaaugagcgagcgagcucagaucuucucaccucaaggcucuuacccacaucggagagcaaaggaauaggagaauagcugcugcugagcccaccagguuccaacggauagguccaaacccacucacaccgacauugacauucucaguuaaauuaaguggggagagagagagagagagguaggggggagggacggggggggacggaccacaggggauaagaggggaaggaaaugaaugcgaaaggaggcaggaaaaggcugaugaggacgaggagcccagagaugauggguagagaguagucggaaugcauuacauacuugcacaacacugucaaggaauaaaguuaguaacagcuacauuuccaaaggccucuaagaacccaaccacaagcccccaucccuaaaagcugcuuccauuuacuucaguuccuagcucuccucuguuuagucauuuguucuggugacuguuuucagacaccuggcuuuguucaucucugauugcccaguggcuggguuaguaaaagagaauauucagucaaauagauguauuugucaagaguaguguuguacauacagaugcucuuucagcuauuaugaccgauacaagggagaggggccuagagggaccuuguuucucagcagguuuacugcccuacggguagaacccaggcccuaccacaugcuaggcaagugcuccaacacugaacuauagccccauccugggcuccugagaauaccacacauguugguuggucauacccaguggaaggguucagaaggaaaaccaaguuauuaaauauguuacuaacuagcagcuuaacaacugucacugcagaugaccaaguuuacagagggccagcagucucugcguaaacagucaccacagcugccuggaggacacagcuauaaaauaggacuccauuugcagccugaggacuaguaggcuuuggcuacacagcccacgcaguaggaacaucaggucacuucauuugaaagaaaacaaugggccugagguggucacacaggccuuuacucccagcaccugagaggcaggaagaucucucugaguuugaggccagccuggucuauagaauaaguuccagggcuacauagaaaaacccugucaugaaaccaacccuccacccacaaaaaaaggagcacugcuugugugguacaagcuguccacugaccacaaaggcgaccauacacauacagagcuuugggacccacacaggaugaggggaacauuaaaagugggacucauuccaacaccaaccagcaccccauauacaggaagaaaagaggugucuccucaaagaugccucagaagcgggcuuuucagaacuucgacagacaggacucugucugugagggugagcaaacacauccaggaggaacaagcaccuggcugcaccagucaugagaucccacugcuaagucaugcaugugacguucacacugcaccagucgugagauccuacugcuaagucaugcaugugauguucacacugcaccagucaugagaucccacagcuaagucauacaugugacguucacacugcaccagucaugagaucccacugcuaagucaugcaugugacauucauacuucaccagucaugagaucccacugcuaagucaugcaugugacguucacacugcaccagucaugagaucccacugcuaagucaugcaugugacguucauacuucaccagucaugagaucccacugcuaagucaugcaugugacguucauacuucaccagucaugagaucccgcagcuaagucaugcaugugacguucacacaucaaagugaucaaccagugugaucaacaagugucuccaggagacagaaaccggcgggacucucaagucaagucaccuggcagaggcuagguuggcaagcagagguugaaauaaggaagggcuuguucccuucguucucauuucaacauuguggcauuucagugugcuucuacaacaagcaguaaagccccaaugugucucccccucacugcugcaggucgugggacaaacuuggcuauaaaccacacugcagagccacugacuucaguacugccucuauuucuauguccuccuggaguauuaucaaacaucuggaucguucccuguagaagugacagcucauagaacacagcuuucccuuuagauuagugaggcauggugucugcagucccagguacucagaaagcugagguaagggggcagcccgauucccauauuaaaauaacaaugacaaaaacauuuuuuucaaagaaacacauacuaauauguaauaacacaauacguaaggauuugcauauuguuaccuacuggcgcaugugaaugaccuuuaagacaaaaaaaaaaaaaaaaaaaaaaaaacuccaacuguuuacuucaagccuagaacaaaguuaaagcagcacgagaugcuguuugcuguauguuuuucuucuccugcccucuuucacaauauuuauuugaaccuuacuguuuccaaacaaucuguuacugcugcaguaucagucuuuccaauauuccagcucccccacuuucuuugcuuauggaucuggagauuaacuauuaugaaaugucaccaugauuuaguaguuaagacaucagcagauucagauuauuccuugagcaaguacacagugagguuaaggucaaggaaacacacacacaugguuucugccaaacuacaaacgauguuagggcaagugacccacuccaagcauggaagaccagcaggggaggcugcaggggaggaggcugcaggggcgggagcccgggagcccacuggccacacagcaggagugcugauagcuacagagccagcaagggugaagaggugagggcucuugauucaaggacacacugggcacauuuuccaguuggagaguuacagugaauuaaggucacuugguauuucaaguguuucccaaacugugucugaaaucacuccauucugaaaaaaaaaacgguuacugaucucgcaacuaccaaacagcagcaaacauuugcacaaggguuucuaguggcugcagguaaacaggccuuggaucaccuuaccguggagauggaacuguacagacaggucacuuuccugcugccggagggaggcagucucuauaccaguuaaucuucaaguccacuuuguauauaaaaauagucguaggcucacuguagagaaucauuaagccauucacagaguuucguggcaggcacaguucuuucucacacaugaccaaucugaggaccaccaccgacaacuucucauagcacagaguagaaguuacacccauacauuuuuagguggaaucgccucacagagcuggcaugaaaccuacaccugccugagaaaugccuuggggcucuaucuacuacaaccccaaacuaugaccaagaaccaaagccuguacaacucuagacuacuccuuguaaacgacccagagaaaagugucuggcacauauuaccuuauaaaucacagcuacugggcaccacugcucagucacagagcugaacucagagcacacugcaauuucugagugcccucuccuuuccugacaggagccucacguauauacauaggccauaugccucacuccugaacaugcugccuucucucaaaaacucaaaauuugcuucuaccaccacccucuuugugccuuuaaagaaaagcauugauguuugaauccaggaaagaauaaauguguauauuuuaaaauauuccacuuugagaagaaccaaagacucaaaggugcuuucuuggaauggaauuuauguccgcuggaauaagaggguauuaauaacauuuucuuccuucaggccucuggagggaaacuacagaccaaugucagcacaguguaauggauaugagacaaaggagguuucuuccauaaaauauugugcauuaggguuuauauucuaugcuauaaauauuuagcagaggguaauaugacauuuacuaauauuucuaucaaaauagcaguaucuuaacugucauuuuggcaggcuugugccucucucugugauacuguaagaaagcauugacuaagcaucgcucuuuuuuuucccuagaaauguauucugcguagcacuaccaccagaguuaaccugagacugugacucaaaggguaugauacagcccuaacacuacaucaucacuggaaggaagggaaggguuuggugggagaaagugacuuugcauaagccuccacuuucauuagcaagcucugaaaaugcuuuugaaauggaugaguuuacugauacacguucuuuuguaagugcuuguuucuccgagaggggagaccuccuguuaacagcugguguucacaugucaccucugacagugggaucugcagauccacgagcacuugugcuggguaagaagcagcuucauugucacacugugcuccugguggggguuuugugaggagaaggggaaaccuggagaauucagaccccuuugacaguagugaccuggcccuagagguccccaguggugauucuggagaacaguccagccuuugugucugcagagaaaagaagggccugagauuuucuggagaggaaauagaaaaaucaauacauguuauacaaugcugaagcaagcuacacguguuuacagagcuucggcacacagaaacauccacuucgaaggccuguuaaucucaaaccuguauuuggauuucccaagcagucaacuccuaagaaaacagcgacucucacugagccgaaaguuuuucacguacccacgaguaucuguacaaaacacuccaaaacuucacuccaacuuaccacaagaaaaccaccaguaacaaugaagaauaguauuuaagauuugagcucugaaguuggagcucuccucuuuccuuccccuuuguucccuagggauauuacuauaagacagauacacauaagacagacuguacauaaauggagcagcuaugaccaucuuaaacugcugcccccgggaacacugcccaccuccauuuguccuuacaauacagacgucacacaauacugacuuguuuuaaaaacaagucucuuucugaauugacaucagaccaaaaacauuuuaaauuuagauuuaugcuuugucuuuuaaauuucuuuuuuuuuuuuuuaaagauuuauuuauugauuauauguaaguacacuguagcugucuucagacacuccagaaaagggagucagaucucguuacggaugguugugagccaccaugugguugcugggauuugaacucuggaccuucggaagagcagucggguguucuuauccacugagccaucucaccagcccgucuuuuaaauuucuaaagacaaaucucauuauggaguuugacuugaggaugcucaggccucucauauaaaugaaaaugcuuugcaaacacuuaaguucccuucaugauggauauucaucuggguaucagucauuucccauugagaugagcagauagaauuaaagacugaagaccccauguucucuauagcuccaguacucuaccagacaggaaaguggacaacaccguagguaggauauuuccgcucuaccagccucuccccuucuaccuucuacuccuccucuaaaucacaccuccaguuuguacaaaugcgccacacaucacacuggugauugugaacucacuauauccuuuuuaucugccaacuguguuugaucacagaacaaccaccacacauucagucuuuaucgaucacacagccuuauuuuaacuuaagaagguaugagccccuuaucucuugggauggguucuuucccuugggccuagcucucuacuccauccugcauuuucgcuucuaugagucaguacacugaaaucgggcaaucuggggaaggggguccagcgcucuuauccagucugucaaucaaucacacauuacaaaguaaaugaccggaacugucaucucaucagaccacuaaaucuuccuugcuucguccuuuugugaguaaacuuuaauaaaagcuaaacaucuuaacaaauucaacauaaaauuaaauguuaaaggaaaggcucaugguacccauggugucuacggagcaccagaagaugaugauuuaagcagggaaaagaugugccuugggcuggggagaugggauaaucgguguauuuauuuccuugugagcaccaggaccugagcucaauccccgaguuaauauggccaaggcaggugugaugauacaaacguguaauccuuguguugaaggggcucauggggcccugaggcucucuaaccagccuugccuaccugcugaauuugauuucaauaagaaacccucuaagggggggcuagagagaugguucaguggucaagagcccuggauguuucuccccagguacugaguccaguucccggccugcacucacacauggcacaugacaacugucuagaaugugauccgaugccuuaaucugaugugcagauauacaugcaaauaaaauacccauaaacauaaaauacauacauacauacauacacccucucaaaaaguggggaggugaaugacaucuaaggaacauuaccagguuguccucugaccuucacccugaaaccccgcccgcacccccaccagcauccccaccugcaccucaccuccacaccugaacccccaccugcauccccaccuguacccccacccgcacuccaccuccacaccugaacccccaccugcaccccaccuacacaccugaauccacaccugcacaaacuugugaaaaggagugcguuaacacuuaaugucaauaacccaucaggcacugugacauauauuuuaaucaacaaucuaucacuacuaucaaaccacccugccaggaacuagcagcuacaaaaaguucccuagaagaaguugggggugagugucaguguacugcaggcuuacagaugguuugacagcaugcggaguaaagucuccuagguauaagacuucuucaaaggcaaccagagucuuauagugacuuuucuccuuuaugugagaguaagauaacguucugcuuuuauuuuaaguauuguaagauaaacggacugaacaucuguuauuuacuguaaugggucagaaccucggccagugagucccuugaaacgacucaacaugaaagagaaaaaacaaacaaacaaaaaacaggucuuauaaaagagcauuaguuuuugcuuggcuugaauauuuucuguuuuacuucugugagaguuauacucuggggaaccaauucucugccuucuauaugucucuucugggacagaugcuccaggcuguaagccaccuauagcacgcagccugcauucuucuagaguguagacucugacuuugucccagcuccugcuccacaggacccuucaggaaguacuaacuggacuugagguaaaccauuccagaaauguuugcaugucgaagucacuguacuuccugcucacaugggcagagucugccacugucuuaugaagggaccgggcaucuguaagaacagggaggaugaaauuauuccccauggcucguucacauguuucucuaaaaauccauucuggauaaggacaaaggugacccucuucauguuaaaacacccgucuugcugaucccccaucacugugagaagcugggccaccuuggacauggagguaaacauauacauacuugauuuuggagacauucuccccuucaguguccugggccuccccaaccccaaguggaacugaaggacugaaacccacccagagcaaagucccaggucacagacuucacagaaacagagacacaaacaugccuuuccucucccuggcugucacagguagucuguacugaccagugauguauguagcacaccaagcaaaucaagccagucacagccagcacccuggcuucccuuucccacugaccaucuuccuccagccugcuccucuccucaacaugcucuuccuagaaugccaagugcucugcaggccacgagauggcccuucuguuaccugcugggaucugaaagauaugcccugcacugcuguuugucugcaguccuuauuaaacuauaagaucauccuccaacucaagacacgccccagagagcaagaucaccgcaaugaagaacuuuaaaagucacagcuccacauaacugcauuuaaagaaacugcacacugccucuuuggaaaggcacaaaauaaucaauuucuuuuucuauuuguugcuguuuuuaagacaaggucucacucuguagcccaaggugaccucacuauguguguccugggccugcuuuaaauagcuaccucaaucuccucaagugaggacucagagaggugggggcaaacagcaccuggauaguagaugcuggacucugacaucuuuuuuuuuuuuugagagacaugccauaugcaagaggaauaugaccacugcauauuaaaguuauguguuuuguauuuuaaaaggcucaccgucugagaacgaccuuaucgucccugugguuccaaguggaaaauggcaucacagguacaacuaggcaagccuggaacaaugcguuccugcaaacaguccaugguaguuucuuuucccuuucaaagauaaagagcguaaccuagaaauaauauaacuacuuacgcacaaaggaaaaaguuggcaguggcuuugagagucagguuuaagggucuauuugucuuuccauguuacaggaaggcaaaugagcagagagagagagagagagagagagagagagagcgagagcgcgcgcgcaagccagccagggcaagucggcuugcucucagagcccacauucugccuuuaaaacuuaaaaggaaaauaauaauaauaaugauaaaauaagcaaagaaacagaaguggaggaagaagaggggccucuauggcuaugcagagaggcccuaucuuaaaagggggagggggagacaccucacacagaaaaaugaccagaguggcuccugccuuugcccugagcacaaucccuuguucacacaccagggacaaguguccuucagucacuguccuucaagacugacagagcucggugugacaggugcucuuaaggagcuucagaaaagccagcagucugaagaaacacagaaagcgcagucguuacccacacaccaucagggaaaggucccccaagagggagccccgucuuugccaagugccucagagauacucugagaggaauuacauucccaaagacacucaaaccauugaguccaaagcaccucaggcuagggacaggcucaggguggacacacagcuuguggcuugaaggacacgucuuuuuuucuucuaacacccuacaucuccugggauggugaagaggguuucucuuccaccuuuggaagugccacaaaaucagauccuuucagauuaaaauccagccacguggagugagucucaagcacucaauccuguguccgcucccuucaauccagcgugccauauauccagauucauggaaauucuuuauuaauuuacaguaagugcucggaaagaacagaauucccauauaccacuggaauaugcccagggacuccagaggcaaucuguucucaaccugccuuccccgggguagaaagcagucuugagaaccauaaacauauuucugucugccuccccagccccagucaaccaccccacccuacccuugccuccaaaagaaacuuccugccuccagguguauguauaaacagauguggcaaaaccauucaaaaaaccugccauguauccaagccaaccacuuccagacggacagguccauugauaauguggaacugguuuuaguuagaaaucuaccuggggugaguugaucugccuacaaaacaguggacuugaggcucacgugucacgugcagcaaaggggacgugucaccagggauuagacugagagucacacagucacauggcuuuacuaaguuauuuccccuuagcuuguaacccaacaccgcuguucccagcauucagucaggcaguggguuucaauggauuccaccgcuuucaaguggugguucguucuguaggcaugacuucgguauuuuuccaaaaguacuuuauucagggacacaauggggccacuuuguagccaaguccuucauauacagaggcagguuggcagaggcugacuuuauucuguucuguaguccggaaagugucaggacuuaaaaaagggcaaacuacccuacaccaggacugcucuccgggagggaggcaggcugcggcacuucucaacuccuggacucuggacccagggaaacuagucucuugcugauggauggaggacgcuccugugaguauuuacacuacacugcaggcuuagggaaugucaccaccaaacagugccauuucaauccuuaacccagcuccaagaacuccucaagugggugagagaggcugucauuccaucuuccugggcucccugaccucaggagugguuagagcagcaacaggagagcgagcauuuccauuucaggagguuaaaguacagacacccgcucuaccaucuugugaccacagccuggugacaauguccuuccagagcaauuccaaacaagcccggugaaugaagaauacaugcagagcucgacuuuccucugggguucaagguaaaaggcgcagagggguuccauguucaguaaguauggcgaacacuuauguucccagguucugaggagaccauggaaauucucugcauguccucaagcauacaaaggaacacgaagugacucucucacugacccggaaagaucacaggcaguacuucccuugcgacuggaugagcuauuuucauugaaaauaauuuuuaacucagugguuaacaauuagaguaccaagugaugacacucugcaauggugguaauuuuuucaucacuccaguuaaaugagccaaggaaaacaggcucaagguuuccucacuuuacccuuaauguccaagguucaaacacaugcugguccuaaaggguuggagucaaagcccucacguaggucaaccugagaggaaagagaacucuuaucuguaggcucugcguuuaaguggcuguacuugcagaaaccuaaguaugucugacauucuaggguacccagagaccgaacaucagaagaaagcaggagauggaggauggaaggggcaacgaaaagggucugcuguguggcugaccacugaaagaccaacaaccccgacuagaucagaaagcaagaccaacagccccagccucuaucuaggccgugcucccgcauguaggcuguguagguagagcuggcuuaaggaaacccagcaugaacucuccaggucuacaaugauuacuggugcuauccuucuuagucagaccacgcgccuugcuuugccugaagagcugaaugucugaacuauagauggaugggauccaggagaaacucacaggaaaacuaccacgacgcauuacaugugaguaugcacgacguaaucguaacagacucgaguuaucaaaugcaaaauucaaaauaccccccucccccccaaggguuucuaguuauccccacagugcugacagaugcucaggacaaacuccacagaacaacucaaagccacaguccauugaauuccagugucuauguccuggcuacugaccgauaccaccuccuacaaacaguccuuaaacaguaaaggcgucuaccccugaauguaucacguuaacucuggaugacuuaacacucaaaccagugacuacuuuccacuccgugcucucaaauuuggagcaacggcagguacuuccaccauuaugagggaacaggaacugugacaggugauggaaaggaagaucaagaaucaaacucacaagaacuucagguaccugucugguacaaccaauuccugguacaaauuagauaugcacaguauuacuucuaaaaacacucuguacauuaagaaaaugagauucuacuccuuguaacaauaagucauucucaugagcuggagguuaauuacugggagacaccaaccaauccaaugaaagguucagcugcaaaacugaauuuugaaaucauaauuauaaacuacaagaacugggagcgauuuucccccuuuauaagcuggccaucuucuaaacacacaggcaaaggcacuuaagugugucuguguucuuucuccuuuacuacaaaguaucaaaacaaaagaccuuagacaugugaggcaggggaggcggcucaccgguaaggucacaaaagcaagaggaccugaauucagauccccagaacccacugaaaagucagaagaaggcggacagugacagguggucagccauucuagcugguucagucaccaguagguucagugugaaacccuagaucaaaaaucacacaaggugaagagaagcuaagugugacuucuaauguugauaucucucucucucucucucucucucucucucucucucucucacacacacacacacacauacacauacacacacacacaguccuuucuccuuaaaccuguauaaagguauaaugcauuuccuaguaaaaucccagcaacauuguuuccaguauagacaaggugaugguaacuaaguuagcaacaggaagaacuggggucagguuaucugauuuuaaaaucuaggaugcggugagaccauucaaaacuuccugacacuggcaaagaaacaagccacacuccaacgcagcagcacagagagucuggcgcacagccagugcagcacaugacagagcugacaaggcucaaacucaguccaauggggaaagagcagucuagucuacagauggcgcucccgggagcggggagaaaauucaccccaaccucauucuuauacuuuacuuaaaacaaaacaacccaaacagcucacgccauucaaauucaacuuaagucaucaaacaguaaaguuggcagggacuggggggcaggggaucccuggaaucuaucacuagacacagaguuccugguuuagguuacaagagaaaaaaaaaaucauaaaaagaaaaaccaggacaccaggcuuucacaaaauuaaaaaauuuugcucggugaaagacuguuaaggagauaaaaagauaaagcacagacugggagaaaauauuuacaaaccacgggccugacaaagagcuggagucugggaucuauaaagaacucugaaaacucaacauuacaaaauaaacaaucuaauuagagcaaaagaugaacagaugcuucaccaaagaggagggcauauaaauaguaaacaaacacgggagaaggugugugacaucauuagccaccagggaaaugcaaauuaaaaccacaaaugagauagcacuucauaucaacacacacacacacacacacacacacacacacacacacacacacacacacacaaggaaguuaggggaccccuggucacucagacuucguugaggagaauagauuaaaaaauggcacagcuacucuggacuguuugggugucuuuacaaacaaacaugcagcuauuauucuauaaaauagaaauuaaacuugugacacuucucccaaagaaaagaaagcuuacauuugccaagaccugaacagagagggguggauagguaaacuaugggauguuuaaaaaggaacaaauauuauaaaaugacccuaaagugauaagccuuugagagggaguacagauucuuugugaccuugggaaaggagguuuacaguaaggaggguaauagguaaagagauauggacccacgcacuggccggaugcuuccugaugcagcaacagcaauuugcuguuugccaaacuguauuacaguuuuacaaaguguggggggggggggcgcagacauagcaugggauaguguaauuucuuguaacugcucgagucugugacucuacagucucucgggaaugaaggggguuuucuuuuuaauggacauaaaaauauuccaacaaguaaauuaauuucaugccuucaagcaggcuaagcagauggcuucuugcaaaccacacugccuugguuacaggacaucauccagacucaggacaucuacugcccgugcacuaccacuucaucggaagucacagcuccaaaaggggacuuagcucaagugugcauguagaaacgccaucucuaaguuagacugcauucuuagcacaaguugcuauuuuaaucauaguagcuuaggaacacauacggugaaaacaagacaauaaacuaaaaaaaaaaaaaaucauaauaucucaucaaaguuacuggcacaaacacauuucuaagccgauuagggagcuaaguucugacaggacuauuugcaagucaaagcaagcccacccaagacaucccuacugaaggcuuguuuguaauguaacauaaacacuuaaucuggugcuugcaacaguugccuuguccuccuaacaucaggcaacaauuaaaaauagccaggccaaucagaguggucuggcugugaaugacaaggaaaaguaugaagcuggaaaagguaaagaaggaggcggagaaggacccugggacucucuggagcugcacauaugcucugugcgugucuaauguaaacagugcuguccaaaucaccugcaauaaagacucaaggaggcggagaauguauaugcaguucauuacuuuaaaauacaaccauaacauauacauguagaccacuuuuuguuuauuuucagacaggauuucucuguguagcccuggcuguccuagaacucccucugcagaccaggcuggccucaaacucacagagauccuccugccucugccucuuaagugcugggauuaaaaguaugugccaccacugcucgacacaaauuuagauuucuaucaguuguaguuaaggaagauuuuuuuuucauguaauuaaauuguuaaaagaaaaaaaaaagauuauucccuuucaucccaaaugcaugauucaguuuaacuaaaucuaguaccaaguuuugucccuucuuaaaaaguggcugaaucagcaacucacaaacugaaaucuguccaagaccucuuuggaguaaaaggaagguuauuugcucaaaccaguaugaaccacugcagcauggacuccucuguccacuccugaagugaggcucuggaagguuacaaucuuaaucucaaucucuuccccucccccucccccccucaaaucccccagugcaggagauugcuuuacggcaugugguaugggccugguguggucuccuauaccaguuuggauggagaagaagacagaaggacacuccacuaaugcguuuucuuuauuuuggcuuggcucuuuucuggaggugcuuggcaugcuugggggcuuaccaacuaucucaggaucccugcaacacguggguacuccuagcuacaucuaggacuuuggugguauuuagggaacaggggucuacaauucuggaaaaguuaugcuugugacuuuaagugcacaaggcaguuugccggccgaugucaaacucagaauuagggggguuagguagaccccauuuauagcaguaaugccccagcuuagacucuugaagaauuaaaagucuccaaauuuccacuaugcauuaggagaaagaguaugacagaaaagugguaugaacuuccuucuggaggguuggacggugagccuucucuacuaagagcuuugagacagugaacagcuagccuacgaaccacauuaaaaauauauauauguguguguguguguuaaugugugugagugugagucuuccaccccuccacacacacauacacaaggugauccaucagcuuuucccuugguugacuggccuuucaccuaacugugaacuguguaggccagugcacaggaagaugcucaaguggaugucagcgucugacaccugcgucacgggaacagccagugugguccacagucuccaucacaugcccugagacaugcagugcagugaggaugcagggcucuccucuaccccugagcuugugacauauacaugcuucuggugaggaaaccuguaagguggggcagauuuacaaacuugcccuacaaucugcugauucucucuuaacuuaccaacaaacauuaacugggauuaacucauugcuucugugcaaaagcauuugauaaacaacaacaaaaucuaaacugaaaaccuggguuucaagcauuauaagcagacuuuucuacucaggaacucuccacaaaacauaaauccuccgguggaguugaaaaugaucuguuguaugguauuuguaacaggcuugugugggcauugacugcuagcaaaggugaucaggcaaguccacccacucccuggccacucauuacuuuuucuuuaaaauaaacuauaaaguuuuggggccgguggugcaagcuuuuaccccagcauuuaagaggcacagaugggcaaaucucuugauuguuccaggauaaccuugucaacccagggagcccuaguagccagggugacaauauaagacugucuuaaacaaaacaaaaaagcaaaaagcaaaagcaaaacaccacuaguaaacuuuuaaaccuuucucgccauuauagccucacgaaaaaaccuuacaguuacuuaaucaaaugcuaacacuguuuugaaacuguacaucgcuguguacagggcacucuuucagcuucuuaugcuaggggagaagggugucuucaggccuuucuauauuguucaguaagacugcagauuuccugugaagacgcccuggaccuuuccuguuagacuuacuccuuguuaucuggguucuauaauuaaaaagaaaugcacuuuuuaucacuucuaaauacauuaagcaauucaauuaaguuauccaucuaaaccuuaaggagauccuuacggagcuagcgugccugagugaguaguagggaaugauuuguaauuagcauguuaauuucguccguaaauaggaaauuaugaaacucagggugcugaagaggguacuaacguggagguuuacaccagcaccuuugucaucucauugaccaccgauucugaccacagagcaauguuaaaugagauacuacauuagaacacgcuuggagaagugucuggcaugugaacauucaaugcacaugaaugcuuguuaccacagacugaaaaaaaaaaaacaaauaaacaacaaaacaaaaaaaacccaacaaaacaaaaccaaaacuccaucugacuucaucccuggcuaccuggacaagucaaguuaaaaggcuacaacagagccugaacuucccauguaggacucuccaauaaccacacugaaaauuaaguucagauccccaugaugucccugccuguggagccugguaagaaaacccacugcucacuagcucaucuccaguugcuuggauccauaucccuugcucgcucaggccuguucggccuauuccugcucccagacacgguuuuaugcucuggcuccuauggaagagauguccucuuccacagacuggcucuccuccaaugaucacgugucacuaccgccuagagagagccuggaggacaguguugaccaagugcuggaacagcaccagcaaagauuuugaaaugugcaucuccaagucaauaaaguuugccguaggucagaucuugaacucccaaagcugcuaucuacaaggagggcaaccuggacuauaccugaaacuucuccaggcucagccucugugcagagggagaagcaauauuuaaccacgaaagaagagggguagugaaggguacuuacuacaaagcggugcuuacagauaauuccagaacaaauuuggaggaggaagaggaggaggaggaagaagaaggaggagggggaggaagaaggagggaggaggaggaggaggaagaagaagaaggaggaagaaggagggaagaggaggaggaagaaggaggaagaggaggaggaggaggaggaggaggaggaggaggaggaggaggaggagacggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggagaagaagaagaagaagaagaagaagaagaagaagaagaagaagaagaagaagaagaagaagaaguggugccuuaaacucuggaaagaacuuggggggggugggacacaaacaaaacaaacacaaaaauccuucaagccacucuuuucaaagcaacauuuuagaaucaacugcauuuuacaagucacuuacaugauguugcugccacacagucacuugugcuagauuauauaaccagugggggggaaaaacucauucucuugggaauuuccagaagucugucacagagccaaaacacacugaccuugaauacauuguucuugaacagaguggauguacugaacgcugaauagauguuacuaccucguacugagcacacagcacugaaugcucucauacucaauggccugacggagaugcuaggaagaagaacgcaugauuuuuaaucucauuuaaaguauauuaugcacucccagaguacuuaagagaaacuauucuucugcucuucgggguuggcugucuauucaucagaagacagacagcugguuugggggcugguaauggguuuuuccauuguuugugaaagacagggagcuacggauacgcuaacuuccacaguggcuacggagaccagucauaugaaaaggggucacuaccagagaccugcugcaugugacgcacccgcucacacuugaaggccacuauugaggccccugggaaggaggccuggugcugugggaguggagaggugagcuacaacagggcaagcuaacuuccucaugccauaggacacacacggggcuaaaggaggacacugcuuacagacagaaagccaggcaaagacagcaugcagacagaaagcaggaccaugucaguccuucuccuccccccccccccagaaggcccaucuuccugcuccucaucaaggaacccacacguuauagucuaugagccacuagccaagcuggguuucuguaccauacagccaacaugaacacugaguaaacaccagccccucucuaagucucaguuuucucauccauaaaauggaucuguagucaggcaacuucuggacaaggacaagugagugacuaugaacaaaguccacagcuuggagaaggauuguggaaaagcagcagucaacacaggcagaugggcaaggccuguagcucuccgucucuuucagucacucuugcgugaaacuggccaugcgguccacucaugcagugaucucaggacccguuuuucugcuccugguucucuguaccagaugagcccggaaccagcucucaccucguucugugcucuuccuguagcauaccuagcugucaugaaucaggugcucaauccaugccugcacacacaacgcaguagcauccggcuucauucauguucauauuggaaagucuacuuccugucucccauuuucuggcuaccagucucuucacauguggccacacgagagccuccagagaacgcugucggcugucucucagaacacauacauggugcucccaagccgcuuuucucuguggccagagcagacaucugcaguccuggugcaccccuaagcucucuuccuuccacuaacauacuguucucuccaucagcugucacggugcacagggcccaucuucccgugcauugugccuccagccugugcuuuacggcuaaugccccaggccuggguagcuacaccccugcccugcacgacuucauccagacugcuacaauggccuggagaaacugccugucccaucccugggauguucagcgcaagauuccaaagccaccugcacccuagaccuuugcugccaccucuccucgcugcagggggaugcugagguauucugguaugggucacacagaaggcuguauccuaaagcaucacguucuuucuugaggccucuagaagcucaaagccuccuguccuccaaccgaugaaaacuaaguucaaaguaagaaucuuuucucccugggguuugcaauagggcuaucgauaagcucugaugguagaaugcuugccugaagaccuggauuuaggacacauaaacugggccgaguggcaccugccugugaucucagcacucaggagggggaaagcgaaggaucagaaguuccggucauccucaggcugcacaggaagucaugaagacuaaagaccguguccacccacaaccuaccccuugccccuaaacaucgagaaaggcuccuuacuguuccccacuuuuaaccuuguaaggcacauuuaccuagucucuuuaagcuugagucacaugaaggaaggaaugguccacuuaaaacaaaccagagggagcagcuccaaggagugccugccucccuucugggggcaagcucagaacccaaacaaaggccugauaggcacuuugguguguuuuggaacacuggccccuccuggcccccucccacccuccugcugcugcgguggcacacgugggcuggcacagcacccugggaaagagaccgcagcccucccuggcgcccagugauuauagggcaaggcugaaagcagcaacaaaaccgagaaacaaagccuucugugaaaccagaaaccacaggaggucacaaaaacagcaagaacuuagaaaucccagaagcccuuuggugagaaguuccucuaagcaccuguguccagcucugaaaugggcagcuuggcacguaccagaaacgacaagaguaccaaccaggcucuccuccaggaagaccagucuaaggcgugaugguuuaagauguuagccuacuggguucaucggcagacuaacaugacaagacgacaacugcuuucaaaucauuacugaggcagaccaugucauuacacaugggcacacauuauacauguggcauuaggcaagugcaggugagggagauaaugccaaugguuaaagugaggguggacauucacacacauacaugugcucuucgacagcuacaggcucaggaaugggcgggguaagcagcucuuaaaagcucuauggaaugugggauauuacgcaaacacaacuccacuacaaacugcagucucuccuuuugaaagaaaccucucucuugcccacuagcccuauccuucuaggaguuuaaggggaaaaucaccuaaagcgaaagccagagccagucaagagcugcccaaaggggugugcaauuacaugugauuuagaaagucucugcaugauuaaaggcagaaagacggcugaguacuuggcaccggcuugaaacugugcuuaagcaagcacucuuucaacucuccguccucuuccuccuggcacgcagcucccugaugggcacuaggugguucagcaggacagcagcucuccagguguuauuugcagagcugcaggggugcuagggagcuucucaggccugcagcccggaaccugcggauucacccaaagcucagggcuggaaucuaaucuggugacccuaagucucaagggacucucaguggaagcccacagcaucagcuccaugccagcaucccgaaagcuucccuugaucaccaagccagugcugccugaggcuuuccuauauuagaccaacuaagcaggccuccccuaagaguuucuaccacauguacggcucuugagcacccugaaggagacauaauugugguaguagcagugguagguagcccaggccaagacggaagaagaacaggagaacaugaugcccugaccccacaccugcuugcagaagguccuuacuggcuuuccaaggacucaugccgcgucccaccccccagaaagagugauucaguccgucugagaggaagggagggaggcagcccaaucuuggcacuggaaacaccccuggagugauuauaacgugaaaacaaguuuagaucuguuacauucugucacuauagcacugugcaaacagaucaggcagggcucgagggcacagaggggaacgaggagagggaggccuccugcgaaaaccuggccuaagucagguguguaugugggaaucacccagcuagggugggcaccagggaaggccuggcauaagucauuagagagguuccuuuuagagggcgcagguugggacggaggcaggugguacucucccuuacacaugccccagauggagacgggauuuagcccagauuguugagguaguauguaugaagugggccagggagaccccgacccagcuucccugguccaauagccaacagccagcuggagcucccauguucucuccuuuuuacauguacccauuugaauugcagcauaaugaggucaaucauuuugauacauuuagauacgaaaugcuauuaaauauguuuaaaugauauuaaauagguucacacuguguguggguaucacuaccaucuuccuguaaaacuugcagaaacucaacacuacacugucugucuuugccaaacuccagcagucacuauucugcagcugcuggcucuguccuaguaaaaccacugacugugucuuugggugacuggcuauuuuauuagcauaaugaccagaagguccauccacauaguauccccacccccauucuuacagcugaacgauauucuggauuuuaaacggaacuauucucaaguauaaaaucccaacccacuagucgagucuuugccauuuuuacaacugcaaacagagauguuaugcuucuucugugaaggaugacggcaucgucgaagguaguccugauuuucaaucucugucuuuuguucuggccccaaauuuaggccaguggaacccgaguguauaaccugaaucccaggugcaggugccagacagacuaaacaggcacuucaaagcuguaaagagaaggcacacggcugaccugaagagacugaagaagcacccugagagcuucagcagauacugcuccccaccugagacccucuucucuccgcuggagugugugagcaugauguccauccaacccacagccaaauucuucaguccuccugagacuggucaaaagucagccugacugagucaagccagacgauaagagugagggauuuauugacugaaacggaggaaaacaaaacacaacccaaaacugguuucugggcuucuacucuggcggccagugacuccagucugccccauuccccacuguaacagccacagggcuggcuucccuccugaucucaagguggcuucagauacccauuugagcccuaugccucugcucuauccauaugcgaggaguaugcugcuucuuagagccaccagcguucugacagaucagccuggcugggcuguggacuucagccagaaggaagcacugauggugagccuaugccaccuuaaccucaacuucagggugugccugcuguaccacacagguacaggagcccucaaacaaaaaggcuagguacuacgugcaaaagaaaaugucgaucuaugcccuucuaggaucucacggcuuaggggauacugcaaguugaucugagugucaaguucccacaugcugcuugcuugggcugucauuuuaauuagagaaaugggcaauguauaugucaucagauuucccuuuuacuugggaaacugacuugucucacacgaucguucuucuuuaccuaggcagacggucaccaaguugagcuucccagaaaacagcagcccuuguuccucuuuugguaggguagauguuugcccagcccccagcguugucuagaugggaacauagacaugaaccauugaaauacaccugaaaccugagcaaaaucaaggacaacaauaaaaugcaugggguacagaagccagggggacguggggggugggggguggggggugggggaaaaucauuaaaguuccaaugcugcaaacaauuuccaauuucucgcagcuacucagaugaccagaaauaauuuaaaaauccaacucaguauuccuuccaauagaugagcccauaagugugagacaggcuucuguaauucugauguuccuguaugagucuacauaugugcaaguuaaacaggagcgagcuaugucacaauucgugauggugcuauccagccagggagagagagugacucuaggcacucagccuucaacaucuuccucguggaaagcacaggaugugugagcaccugucaucaucauguguuugacuuuugucaggacuuacgagagcucacugucaguccuggaucccugcccgucuaaaccacaccaaguaaccuuuuugaacagucucccuucacucugauucuccauaaacccuuauugguuucaauauuaauccacaccaaaaaugauagcugggcauggugauuuacaccuuuaaacccaggguuuaggaaccugggagguagaggcaggaggaacucugaguuugaggccagccuggucuauaaagccagauacacaacagacagaaauuacauggugagacucuuucucaaaaaaaaaaaaaaaaaaaaaaaggggggugggguggggauugggggaagggugcaggggguauugccagagagauggcucacugaucaagagcagaggacccagguuugguccacagcacccacaaggcagcucacugccuuuaacagucccagggaaucugacaccuucuauuagacuuccuggcaccagacagacauacaggcaaaauaaaauauccauaauauguuuuuuugaaaacuagagaguuuuucuuuuucaggaagacucuagaaauuaauuaacaacgguaaaaagaaaauuacaaaucugauuuagcauuucuuaaguuugcauuagacuuauuuugcaaauuuguuaagucaaaagauuccuuauagaugaacacccgcaagccuuugcauuucaaaagcuuucgauuauuauauagcugccgugcagccagcucuuacaaaaauccaugcacuuagugcaagaaaaauucuguuuguucacagucuggagguuucucuggagaggaacuggggcuguguguaugagcacagaagggguacauuuauucucucugagcucagccguguaagcccaucucucccucacccuaacugcugcaaagguaccacuggacggggaacacuugagcuacucucuuacuguuggaaaacauuaaaugcuucccugccuuucuguuuuuaaaugccaguaucucaggagaaggaaggagggaguccgugggacggccuggacaucagcaacuugauuagccuguggcugguaaacaaagaacaccuugcacucuuuaacaaccgccaguaauaaaaacaaagaagccagaaacccaagcucggccuugaccugaagguuuucuacucuuuuauuacugaaaaugcucaaauuucuuacauaaauuguugccuguucauaaaugaacugccaagcaagccugggauucacaccuucccagaaacacagggcccccacaggugaucccucugggccugcaucuauguguaacauuaguuuuugaacaucaauauacauccuucuuugacucacuccuacaaacucuauucuugguucuuuccucauacugaguaaacauggcauguauucaucaacaucacaucuacauggagucuucucuagucagaggaaccucagaauugaauugaaauagcgugucuggggacagaacacacagggagagaggggacugggggccuucagaaaagaauuccacagaugcucacagaagcugucaccugcagcccacuggagacaggacagaggcugcugcaguaugugucagucaucuuucugauguccccacucagcauguggacagaaaacaaacagacagauggagcaaagacccaccacagugccauggguaccucugcacacaaugauaaucuagugcuuaccagcaaugccaccucagugucaaccucuaaauaaagugacugguagccaggcucaaauuuuuaucacucaaauagacuggcggggggggggggaggcugggaugacacaacuaggacuucucaugugacaauugaucgcccucuugcucuacccuaaugcauguaguacauaauuugguacuugaaauugccucuggacuaccaucaucaaagguaaaaaagcaaaaaagcaucaaaagcaaaaaacaaacaaaaucaauacccaaccuaucucuuccucugacuuucuaucccuacagagacauucagugaggccucaaucuggcccaccauuaauucuaaagaggacauggauuugggccaggauuuuuucacaugaggaaggcacucucagguagaccucuaccagcauacagaucugggcggagcugguagggacgggaugugaguugcaaaacagcucacacugacagcaguugcugaguuauccugagagcccaugagaaccugaggccaccccaagaccacagacaccagaagggaacacagaagaaugaaccaagcagaaggggaugaaacuccucaaauaccacugugaagaaaccgugugagaaaauacccuugaccaugugccauguaccauuaaaaaacaaaacacauaaccacuauggcuaauggauguagacuugcuacuagcauaucuggaaaaaggugaaaaagagucagauucucaggcaaaacgagacacagaaaacaaccaagucaacagugucucuuaaaugaaauagccaauaaguuccugcuguaucuuggucuaauuaaaccuuuuucacaaaugccagccaucaauaaaaaaauuauuucuuauccaauuugggcuucaguuuuaauuacuagaagugcgacaugcugugacucugagaggaucugaucuguuggacauauuucuuucuaagccuaaaacagagaaaugaggauggcaugugcuuccucuccuguccccugugccacuguggccagacaggggacuuaaagggccccucagugcaggugagggcagacaacccgagccugcccagaaaaagcaucaaaggaagccagugcacagggugaggauacaaaguaacauucauucauucauucauucauucauucauucauucauucuuccucuuaaagaucuuacacucaugagagcaaaacgggugggugugguaauguguggagggacuaagcaauuuuaguaauauccagugugucccuucauggauguaucagcuacaagaugcacaggacagauagcuguuugcuuacaaacgaaauguuaauaaucuccacuaaacugaaggauuuacauauuuaaauuugccuuuuuuuaaaaaaaaaauaaucuaaagacuucuguagcaaagagacuaagccuagauggucagcccuaacaacauacacacacugcuaacaucauauaggcugagcagauuguauuuaugaauacuaugaauauguauuuaggaacacacacacaugcguacacucaugcaaaugcuuucaugcacauauaaaaaacuaaugaaaaaaaaaccauaaauauuuuguugcuguccugccacccaagauaggguuuuucuguguaguccuggcuauccuggaacucacugaguagaccaggcuggccuugaaccuggagcuccaccugccucugccucucaagugcugggaucaaagguguguaccagcaccaccuggaaaacccacaaauuuuaaagacaaugaagagagaugggaggguuuggagaaaaggcguaaggggaaauguggaauuaauuauaaucucaaauaauaagacauuuuuuaaaaagaguuaaaauaacaggagaucgaguaaacauaguuuuauuuuguaacaaacacugccacuucaccuugucuagaugucuugaugcugagagcugugagagguugggcugugggcuuuugcuuuaaaauccgauuccucuugcauaaugccacaguguagaaagggcagcaaacuguuuaccucagaaaagggauuuggaaucaauagaaaucaaaauuauuaaagaucucaaagaggggcaugauggcuaauguuucuagucccagcuauugaagaggaugaggcaggucucuggagcccaggaguuugaacccauagagggcaucuaccucaugccaacaaaaggaaacaagauggugcagcaaaaacaacagaaauuccuggacacacaagcucgguuaacggacuaaaggaugagcaggagagagacggcacagacaggagcuuuuaugccucaacuggcccccaaagcccaguguccucuagcagauguuugaaaagcuggcuggucugucuucuuaucaacucaaagcuuaccucauugccagaaggcacaaggcacccaucuagcugugugagcugcuguccacagacugaagcacucugggaauuucuauuccuuggcagcacucuccagaacacgucaccccacacaagcgaugcugaggguucugacuucggaggugagacccagcauuccccaccucuucccuagcccaauggcaccaacagggggcacccuaaccuucagggacgccacgcccaccaccacagcaaacccaacagacucaaaggaaaagugcucacugucucuaccucggcagccaccuauuuuaaguaagaaucaaagguauuaauacacuaaauccuauugauuuguuuuaccgagacaagaagaggaugcaagcgggccgcucugcugguagcaguugacugucaacaauaaaaguauuuucugaguuauucacaacuguuaaaacucaucauauuuuuccuuuuaagagccuuuugaggaaggaaaauaaacuuuuugguuucaguuucucaaaaaucugaggaagaugugaauaacaauucaaacaaagcccaaccagcuaaauaccuccugaacugaggcgugcuucaucuccaggguguaaccccaaacagagucauggcauggaaucagaggagccuggucaggaacgggagggggagggggagggggagagaaagcauggaaucagagcuagcauggucaagaacaggagugggagagggaaagaaagggagagggggacagagugggggcaggagagugcacacaagaaggaaaaaaaaaaaaucuaugccccaaacccacugguaucucaucuaacccaagaaaaacaaucaugccagagccauuccucccagagagcagcuauuaagcgauuacauuaagaaugcauguaaaacguagcuauuuauagcuaaugauccagagaaugcaaagaaaacaaauauggaugagaaaauaaaugaaucccagugaaccaugagaaacuccuaucugguuuucuaauugcuggccaggugucacuaggaggguggacagcuuacuaggcaggaggcguggagggcguguccaagcgguucuacucucacaccagguggcccugggauaauguggcuggcuagaucuguuagaaucuuucuagaaauaggauuaugaauuugugacuuggguaaauaacuuccuguugagauucuuuuuucagaguaaggugaauuaacagaguuaacugaggcgacgaugaauuauagguagaggaugaucacggcacuucaagauggucaugcuuuaaugccuucaagaauaaucaaaaugcucacuucccaccacagcagguacaagugaacgcugugaagaucuuaaagagaacgacgaaggugccacagggauguccgguuggauccuugcgacccaaagacaugacuagucaagcgauauauuauucggucccccagucuacucaaaucauacacacaucaacaagggcaggccugcuucugggucugccaguucagagucacuacaauguucaguaugauccuccggugacacacuggugcuggcuccccuguucugguagugaccaaagcucagagauguuaauuaagcaguuugcacaagguaucgcagaggcuuucugccaggaagucagagcuccuuccaucuguuucaaggaagagagaaggagagggcaauuucauuuggagcuaaaagcacuaaugguccccuaaaugcagcucuugaugugcuaauggacaauaaauucccccuuuccuccaagaaaaaguuugucuuuagagguuccuggggcugcaggagucaccuguucacgcccccgugagaagccaguuuuucuaggcuguuggaacagcugaaaggcauaguguuucagucacaugaugacuugugcacauaugaacugacaauauguaagcgugugauuuuacugcagaaaagauaaaaaaggaugaaaugaugcucuucuuucaaugagucuaaguucucgcuaaaucauucauaaaauuggaauuuucaaaauacgcguaccucgcccucauuugguuaaagcauaaacccaguaagcagaaaauugaggggagcugagagguaggaauuagaacaaagauaacuggaaguggagcccugugcucagugaagcucgugggcuaggaaagggauuucuagggauuuggaaagcccgaugggacuaaauucaucacuugggugaugggacaguucauuacuguugaauuuaagccuaagaaauagcggauuaggggacuucugguuuaaagggaaagcucuucagguuugucuuuaagacuaaagaugcccuuaguccagccucucuuuuccccuaacaugcugcuccagauccgaaccaccacaaacugccuuccuccccgccccagccauugaacugaacccgaagacccucucucccagguguaccacaugccuguccaucacacacucuguagcacagcaauauccacuuguuagacggccccuaacuggaucaccaaggucucgaggguggucacugagagugauccuggguccacaacuaaguuccagugugugcaggcagaaagagugagaugucuccauauggggaggaacugcucuaaggcugggauguugcaaagacucuggcugaauguaagaccaguccagaccacagggaugaucacacgcuaacacuagauguuucucucaaguacuuucaccucaauccccaagugccuccuucccacuucucugucuuggcaagauuuguggguuucagagggagguagggacagagaagagcucaucacacagcaacaacauucauagccauccuagaacaaugauggagauguccaagguccuggauuuaugcaauaaaagcagauguucuggauaaacaacaacaacaaaaauucauuauguucacacaauggaauacuauucagucaugaaaagcaauuaaguccugcuauaguguggguaaggcaaaaaacaguaggugaugggucacacugcuuaugaucacauuuaucuguuaucucuaaaaacacuuugcaacauucacaccacgucuuguguugaacaacucuacuuguaaugagguccagaugacccuuguucaguagaagcccccagcacucccauguauauauacacuaacauuccauguaugugaagaaauaaaguuuuagcacaugaauaauuuauuuuuacuuucaaaaauuauaggagcauauauauguguguguguauauauauaaaaguguguauauaaauauauauaugcacacacauauauaugccuauacauauguauguauauacacacacacaagaauaaaggugauguaacaggaaaaaaagagaauaacaacuauggcaauacccaccaaagcucaacuaugaauauuucucuauuucauuuuaaaugacaccauuuuaaaugacuuuugcugauuaauaaggaggaaaguuauaucccagcauagacacaaaagcuucaaguagugaacagcuaaucccagagugaagagguguaggcugaaggaagacggguguuaaauaugcaaauggagugucuauuuauugcuaaugcagacacaaggagaacaaaucccaugcaaugcaccaagcguucucaccaacauuugccuucuccagaagagucaacaagcuugaccaugcacacauaaccaggaaacaugugugcucuagaaacacacacagucauagaaagccagagccaggcucaccugagacaccgcucugcagaaugaguaagaaggucuguuccccuuccauuagcauggaagccaggcucucuagucugaguggguaccaagaaagaaucugcccagugauguucuucuacgcucaucucucuccauuaccuaacacccgaggagaggagaccauugagaacggauacuacugucagaggcuuucaugaguuucaucaaaaaagcaaaggacaccucucaagaaaggcugagugacagcuuccuuuccccuuuucuuacuguaguauucuuuguuuggacuguuucaaagaaugguaaucagaaaacacaagaaaugugccuucuuacauaacacuaucaaacugggcagggacucagcauucccaaaacagaaucuacauuuugcaaaaaagacuuaaaaaaaauuaaaaaaacaaaagcaaaaaaaaaaaaaaacaaaaacaaaaacaaaaacaaacaaaaacccuucuccaaggaaccagggagcaggaccugacauacucuggugucacagugaugcuauguggccuuccacaccuggucaagacugcccuuggcaggcaccacaugucugcagugccacagcgucacacacucagcucagccggagacagacaaguaccauguaaauggucaaaauguucaagucucgcaguaaauaauggcacuuauauuacagcuaucguuauaaaaaucuguaacacuucaagagaccauuauggagcuauuaaaaagauuuuugcauucaguuuucaagaugacuuaggcagaaugccacagcuacaguaauuacuuuauuuaucgcuguguaaacggaccuuaaugcuucauuuaaagagaaaaaccaauagugcucccaugcaauagccgagcaaagcauggcagcgaaggcagugguccugccugcagacacuggucauccuggacgccaaguaagacuucacacacuguggggcaggcaguuaggcugcuggaaaaaugagaagcuagcaagguuagaauaaucugucagaccaacuguggcugaaccucagguagccagagcagaucguucuuucauuuguaggcacuuauacauuuuagauuugacacaauauuacaaacaaagaauguaacaagaaauuagaaguagcuugaaaauauucauuuagacccaacacauuguuucagacacucaaaaaaguuuuacagaaagaaaggaagggagggagggagggagggagggagggagggagagagagggagagagagagagagagagagagagagagagagagagagagagagaaaggaaggaaggaagaaaggaagaaagaaaggaagaaaggaagaaaggaagaaagaaagagaaaugaaaguuaaagccuugggcugaugggauagugccaccaagccugauaaccuaaauucaauucuucagcuucacauuguggaaggagugaacagaccguccucuauucuccacaugugugcccugacaugugugcccacacauauacacauaacacaugcacacuaagucagucgaauaaauuuaaauauuguaguugucauggaagugguuaaugaaucuggugacauacaugccuagcaacaauuuccagguccuuauuugugcuggcaauuucgcaaggacacgagcuauuucuauaguaucccacugcaauagaagacgugugcgucagacaaagaagggaggcuucuacgguggcacagggguccgguauuuugccacaucaaacuaaaucacaggggugcuuuugcaugcgcacccacagcuaccaagaaauuggaaaauauacaaaacaauucaaauaauacacagaaauaagacugucguuaaaaugacagugaacauccagggaguuaggcuaguacuccaguccuuucuagggugcccgagugccacucuguauaaauagagcaugacucuaagucacaaacaccugcaucaagaugccaaugacaaugcuccaauucgggccaagcugguuaggcacuuugcaucauguuuuccagcugugaaaggaggaaaugccaccucucccugugugugugcacacaccuacacacacauaauggaugcuguuaacaaagauuauuccauugagagaacauauuaguauauauggagugauguuggaacaaggacgaaagugccgguugguaagaaauagccuuuucugaaggagaaccgugcgcugucaugcucccuuuauauaagcacucaauucccuacagcuuaauugaaagcaacugugcuccaucagcgugccauuacuccaaaugcagcauccaauggcaaguagccaucuguacauuuuucugccucccaucccacaauacaguaaacgaaauuuacucucauauaaucguauguggaagacaauggcuuagagaauuauacuugacccugcuucuggaggagcaacaagaaaaguggucuaaagaacuucccuguaguauacuggguuagggcuucuugagccucuggcaggcuucaacaucucugugauuuacagacaugaaagccuaucucaaggaacaccaauuucagacccuggucuuucuucugacccagcaacucgaggaggagcucuguggaugguaagacugaacccccauccuagggccacagagcaucucugcugcagcauaucugcuuccugagugggcaucugauaccuagcagucccuucuugagaugggagugacuucugagaagagccaucagcaagccaacaaaaaccaugacucacugaagacagcacaugggccuggggcagagcgaccaagcuggacugcagugggugguacucaucgaagaagaaucgacugcacaggggaaccuaaauagaaaagcagugagaacacacauacauacugucuugaauuucaguuuaaucuuuuaaauagaacagggaaaaaaaaauccacuguucuugagcacuaaauuuauauuccagaggauuagggaaaaacaaugggaggcacagagcaugaauuuaggaguaaaaaagaucacucuggaaacagaacccugggguacacguggugggaacuauacagagacgggcagaugaaggcucaucacggagggagagucagugaucugauacuggcaucuguuucuaggggugggggagaugaaaccuuuaauggcaacacacuaacaggaugggaacaacacaccuuuccaaacugugaggucaacaugggaacgaagaagaaagugugaaauauaugacacgcuagaaagcaggcaugcaaaaauauauucauugucacagucagcaaagaaagucagaaucuucuguugaaagauaaaacugucaaucgggggggugggggaggggggaggagaugaccuagcucuccuuaaaacaaaccugagacucagacaaaacagacgaacaagaaaggugccaaauagagagcugaaguuacagaggaaagcagacaaguguggcaacugaugggucaaacccaacaaagagggaugguguacacaacacagacguggggcacugugagcaggugagucugagugggcagagguucucaggaggagcuggagaguuggcucugcaguucagagcacuaguggcucuguagaggaccaggguuuaguucccaacacccacaugcuggcuuaccacuuggcuacaguuccagggggcucccuaucuucuuuugacuuccauacuuccaugggugccagacaugcauacaguacauauacauaucauacauacauauauacacauacauacauacauacaggcaaaacacauacacaaaaauaaguaaauguagauuguuuuuuaaagcauucuuaaagugaaaaaaaaaaucacacaauuacagagauacuugaacauuuuucuccaguugacaguuaacaacaaacaaggacuugaaaauaaugcaaccaguuaagucugauuuacuaaauuggaaaacgaaaccucuauuuaaaacaaaaacaaaaaaacaaaacaaacaaaaaaucugacuugauuuaaaaauuaacuauguucuuggacucaagucagccucaguaaguucccucagagagguuucagagguacaugcagcgaucauaacagaauauccaaagguaaauuaaagagaaacuuggccacaaacgucuaaacaaccucagaaucaaaggccaagcaggcaacugaaacaaacaaaggugcagaguacagcuguccuccaacaaacuuuccgacuggaugccacuguuuggggaaacaagauggauggucaauuuaauaagcccuggucaaaaguaauauauauacccaccacaaucaaaacacaagguaacuaaaagguuaguguaacgaguccuuuaacgauagcaagucacacgggccucuauaaagcuugaucaggaaagaacaagagcccaaguguucaugaggaacgggauaguaucauguauagcacagguauuaauaacaacagugcaagugcacucccucuggacaaugaacuuaaacuugagauacacugauuacccaggaagcaggaaaaaguaaaaaauaaaaaaaggggggccagcuaagaaccccgauacacccagaagcacuuuuccuugcccuuucggauuucugaaacagcaucucacacuauagccagacucaucucuaauucacuaucuucaagucgcagccuguagccuacuuccuagccugugccccacacaaccuuucuuuaaaaguuuaggggggucuggcagcaagggcuuuuagucucagcacucaggagacagugguagguggaccuuugaguuugagaccagcuuagucuacagggcaaguuccaagacagccagggcuacacagagaaacccugaaaagguuuaagagggcugaaggagggcucauugguaaaaaauagauuuuauucuuccagaaucuugcaguuugcuacaguuaauauuuaaaaaucagauauuuucuacauucuagaaauaauuauagauucuaggaaaaaaauucuucuuaaaucauaugaaaaaaaauauaacccuaacagcaaaauaguaagaauuacagacccaucucaaaacugcuauuauaaaacauuaaauauuagcaacaauuaugguuuauucaggaacgcaaagaugacucaguauuucaaaaucuaaucaauauaaauuaugccacaaaauaaaagcaagagcucacaauuacauugugucaaaaggcauuuaaugaaaugcaucagcuucucucaauuaaaauuagaacaggaauggacacaacagccuuagauggaauacacuguuacugacuaaaacucagaguguccauugcuuaagcacagaagguucuuauuugaaccaguacagugaguacccuuaucuacaaacacaaaagcaacaguaaacagacaagguugaauauguagucauuaacaagagaauuuaauaucaucuuguuuaggagcaaagggaaacagauuaaugauauuugcccaucgauauaagauagcuaauuaagaaucauucaugaaaaucaugaacuucuauaauuuagaaucuuauuuaaauauuugcaauggacaagugaucuauacaucaagaaaaauuaauuaaaacuauacaaaacacuguuaagaacuauccuuuauauaauaucaugagcucccuuuuaaaaaaccuaggcccaauauauuggaugcauguauuuauuuuuacaugcugagaggaaaaacaaagaccaaggacaguauguuuuccaccuguauauuacccacuccccagcacacaauguuuggaucacuuaaucuaugaucugagcucuauguaugauaaucaagacaucuaccagugagucacacaccuagaucaccugaaguacuaaacuguuugugugugcgugccugcgugugugugugugugugugugugugugcgugcgugcaugcauguauguguaaguuuuuauuuacuuugcucuguuuuucugagcuaggucuugucaagcaucccuggaugggcuccaggauuccauccuuguucaaguuccccacaugcugggauuacaggcucuuguaagcagagaccagauacaccugcauuugcacaaacagcuaaugaccgacuggucgacauauuggugaauauauacagaguaccucggaggcauacaaaacuuugaaaacaaucgccccguggauaauuuaucagaaggggaggcaggaaacacccugcgauggcugcuucaggucagcuuggauuucgauccugacuacacuuagccuaugggaaggggaugaugauggccaguccuuacuggccuguugaguaaggaugaaacguuuacaccuaguguuaaacccagucauuacugguauauuuuauuauuagcucauucuucuaaaaaaaaaaauaauggcagaaagaaggauuuucaacuaccccacuguggguuuccaaggcccugccugucagcagcuacauccacagcaugugcuacuucccaauauaguuggguggguguuugggugguugcuuccagcucccagacugaggcagcugguaggugagcugagggucuccccaaagcuuaucaccacuaucccaccaacccucggcuucuaauuggcacuuuagaaacugcaacuucucucaauacuuacaggcagacugcuggcagggacauccuggagaugacucaagacuugaagaaugagaaagggcacaggaggcacuaaaggaggccucuauguccaaagcccccgggacaggaauagaguggaacagaaaccacaagggagcucaugcuacgucuuuuuuucuuuaagggaaagaaaaaaaauguccacacacagucaccuccauguccaccuccacguccugauacucauccaauguaaugugcugauaacauuauuaauuaagaacgaaauaugaaguagaaaaccaucaacagagauagguaaaggaguuaaguuauacacuguaaauggcuuugaauuccuaucaaaggaaagucaaggcuuucguaagaaaugaaagguucuuaaaaaugacagaaacauugcaguaucaaacagagauuguuccaaaagugaaaggggccaagcagugcccagcaacuacauccuuuuaagaaagacaaacuggagaacaagaagaaacaaaacauccggcgauccugacguuaucacuucucuacagcagaaaggccuccugcucacguuuuccaagcuaugugcuuugugauccaaauaauauuauacaaggaaauaaaaccaucugugaggaacauuaauucaccauggcuuggcuaccacggaauucuucucaaucucuccgcagauaacuuuaaaacuaaaugaacuaagccaaaaguagcuggggugugugugugugugugugugugugugugugugugugugugugugagaaauucaauuaacuuuauaacugcacuuuugagagugaagccacauuuucuauaagggggauauaucaaaauuucccugguucucuaaccuagacacauuccugaucucaccugaauuucuacuucauuaguuuuuucuucugaaauauuagcuacuguuguugaauaauggaucacuucuaauaauuaaaaacaauccguuuuauauuuaucacuaucaccugugcaacacaacucaccugagacacguuuagaggauaacaguuaaguuccccucacuaacuaauacuacgacaaacaucucaauggaaacaauugcaaagacagccgcccucgcucacuacaacagccccaugccccgagucuuccuaguuuuguguccuguuuuuuauauaaaacuaacaugguuuggguucaggcaauagccauaaaugccaacagucuacagauggaugaaaucacggacugacauggggaggggaugucugagagagccaccacugagaccugucugagcagucaucugaauggguuuggggcuccucagcucaguacccaaagaaccaacaguauacacaauucuccagggaagaaagcuaagagcacaccaacugacaggcgcuauaaauguagacagucaagaaugcauauggauuuuaugcagaacaugggcuuggagggagggcagagacugaaggaucuccuuacuucaucuuaugcauggggcauuucucacagggccggcaugacaccucucauguaggucagaagcagcagucagagaauaaagugcgacccugggcauacagggaaagaaccuaaauuucuuucuuucuuuaaaaaaacaaaacaaacaaacaaaaaaaacccaccaccucacaaaccugaucucaaaagacaaaaacaagaauuaaaauggaaacaaauaaaauuccauggaaauaauuuaaaauaaagauuaagguacaacaauguugccaccaacuaacaaugaaugacgucaaugcccaaguacauacagggaguagauuaugaagucuucaucccacauaacuugacaaauaauuaaaaacaaaguuaguauggaaugcacagcacagaaaggcuuugagaugccaggaaauaaaugucaaacuaucagaggcucaacuauaugcuuuugaaaaauacauuuuaaugugcuuuuaaaaucuaugguaguaugucccccagugugcucuuggagacggaauuguaagacuuggcuguggcuucuucccuucgacuugucagucagagcgauacugcacugucccuuuaugcuuauccaguuuuacgucuuaaacagaacaaaauaaaaccaaaggccaacaggcagaauaccacacaggaccagagcaccuggguucuguggccccagcucugcccuugguccaaucucaaaaccgucucagagaucagcuuuguacccaggguaugagaaguuggcaagaucgucccagggugccucuuaggccugcuguaccuguauaaggaggccaacuaccuugucugugccucacaauaccuuagguaccaggaggcaagcagggcagcagaacagccugcucagaccaagagacucuaagacacacagccaggugcuugucucugcugcuugccaggugguccucagcuccugcaguccuggccuggacccuggacuuuguugcuacuguuaacuguuguguccuggagaggaacggaugaguuccauggauccaggauguaagaaugcacauaccugugucaaagggguauugcuguguaucagcaauccauucugagcuccgugucccuuaugaggaaggaagggagagggcaaaagauggcuccuuugagacugagagugaagaggcacuuuuacucacuaagaaguuaggauauaaaauagccauuuagaaucaaaagccacacacacacacacacacacacacacacacacaaacacacaaaccacauacaaagugaucaaagauguccccagaugacacagugagcacucuuguuagcugcuccagccacaagcaagagguguuacgccaugcuuugcccacccaggcagucugcucgcagccaaaucuaaucucuuagacaaaauaugggaugagaggauuacauaauuaauuuuccuguuaggcauaauuguugcugacuucgugucauuacagugucaguucaucugguaggcgauugagaucacauucuaauuaccaaaacauacaaacaauuuguaacuguucauuaguaaauaaugagcaaggucacacuggcuagauaaacucuuagaaaaauaaaaaaaaaauuaaaggcaaaguaaaauagagaagaagucuuaagaaaugaaucaaugaauucugcugaaaucccuugcuugggugacuaggaauaccugcuaagcauucuccaccagccagcuguucaauuugauuaaaugucagagugacccaaagcagucugugucaccaagaaccaacaguaagacaaauguuuaagauacaacucuaaacugggcaugugguacacugggagguggaggcaggacgaucaggaacuucaggcuggacaaaugauaagaaugguuaaguauacacauuauugagaguuaugaauagaauuuguuacagauaauguaauucucacauuuaacaguaagugaaaggcuaacuggcuucuauguucucaucagacauguucuugcugaucaucacuccuagaagcugaagauacugaaagcgguacauguggaagcauaauccagaaggaguuuuguuagagagugaucacucccuaauagcaaaacacaaaaacugagagauuaaggccaggcgcgguagcuucaaccaggagaucacacaccugugaucucagcccuuaggaggcugaggcaagaggauugcaguaaauucaaggauagagguaaaacuacucacuccaaaaggggaagaggcuagggucccauaaucccauuggaaggcacagcaccaaugaccucaauaccuacccuuagaccacacccccuaaaggauccaucaacucucaaaagcaucaaaagggacccagacuuucuugcucagaccucuaugggacauuccaugucuaaacuacugacaagauguaaauaaacagaaacugauagguguacacugugaggaggaaacugcugaagccaucaccuucaauuucuauuacacuaaacccauaccaucuucugaacaucuggcauuaaaggguuuaauggaugaucucuugaauuaaugauaaugauccacauauaccuagugaauugcaaguuuguuguucaggacuaaagacgaacccagcuccaaguccacauucaaaguuccuucaccaaauccuaauuagugagaaaccaaaaaccaaaccaaaccaaaacaaccaacccugacaacaucuaagugccaaaacagguucaaagaaauaacuagcaagucacacccauacugaggcccuugaauuccucacccaggggccucuguucuccaacaacaaaaaugcaaguucuuauaaacuccuaagggcauguuuaauucuuaagccuaugacugacaaggaaaugggaaaggcacccugucuggaaaugcucccugcccucuacacggacgcacgcacgacuguagagcaugagguagagucagggcugacaggugcuuuuugggggaaacacccugcagucuacuccagccauaccaccguaaacgugccaggucucgucucaccuagggagcuaagcagcaccaggccuggcucguauguggaugagagaaaaaacacccuccguaaaaaaagaaaucuacucaagagcuguuuguucucacugcacccagccugcuaggaaaccgucucguaccaaccuauggcacauuccaaagcccccguaccuaaccaggacauagccuagcagcuacguuuacuacauggaggucuuaaaaacaauacaaagaugaacauaaagccucauccuggcucucaucuaaauuugcuccccaccuacccugugugcuacacgguguauaucauuuucuuggcgucuacacaaauacaaccaaaauguaagcagccuugucucuucuucaaauuuacaaagcacaccucggcuuuucugcuuaguauccuggggaucuauucagaccaggagcaggguguccuuaggcuuuuuugaggugcaguagacauuucacuccauguacuuaucuucuugcauuaaccagcacccuccugcugcugcugcugcugcugcugcuggaggacaagugggcugcuucuaaaggguuaccaccacagacaauacugcaguccauacccaagcaggugugucccuaagauaaaucuccccaagugccaccuccguguggaaggucauauacaauuauaaauggccaugauugguccaauuugcccucugugagggcugaaccauuuuauaccguucacagcaaugcacuggaguucuugcuuccucaaaauccugagaacacagccuguucuuuuuuuuuuuuuuuaaucuuuucauuaauuuuuauccucccccccccaccccgcuccccaacccacccacucccacuuccuggcccuggcauuccgcuacauugggacauagagcccucacaggaccaagggccucucuucccauugauaagcaacuaggccauccucugcuacauaugcagcuggagccaugagucagaaucaaaacaugaaaacguuucucgcagaugaguuaacacugccaguaguuucagucuaccaucuuuacgcagcaccugcaguucuuccaagaggggugggcagguccuuaauucucaggacaccauaauagcugcucccuacuuucaggaccuggccuuagccagucccaucgcccuuucucaugugaagugagaagaaaagcaagcuggcagagggaauccaagggaaaauggcucagaagugugggagcccugacucagcacugcccuucaucuaacacucacuaaucacgaaccaaccgaccgacuggggucauuagagggaucggaucacauggggucaugcugacaaguccucagcuccaguuaagaguaccuagugacgcaguguggucacacaaaaauuaacucacgugauuucuguagaaauucacguggagggcuuagccaagcaaaucaguacagauuuucuugcuuuaccugaggaacacuucaccucauccuccuaucuagcuaauaucacuaggaaaaaggguauuaacauaaaacguaaagagcauuaaguuuguguuaagauaugauugugcuaaaaccgucagacuguuacucucggcccuccuggucacaguacaggccaaugcugcaaugccagcagugagcagagacggugcgugcagaaaacauccacgucucaagcccugaugcaggccccggcagauuuccuagcuucucuaagguucuaugucccacuguacaaaaccaagagaucgguggcuuuuacucauagaaaugagaaaaauauacaggucauucauaggaaaugucccaucucuaauuuuuuuuaaaaagcagcuuaguuucauugcuauggccuuuaaaggacuaucugucccuucucuuacugaaagcuaaugguugucucugugcuuugguccacccugggguucgaauccucccugcaugucuugccaugcuccauucugggcuucugcacagcccaggcccagcuguguuuugcuuccugccuacagcuccucagcccccauccucuuccauuccagggccacaucuguccccaucacuauacccacuggaucucaggucuggcccuccaaggcauccugcagagauccccauuucucuuuccauuugguugugggcacggacugccuccucucuacucuugacucaacacuuuauggccuucacuuguggcuccuuuacaacucauuuuccucuccccagccauuaaaagacgccacuccuuccgcuccaaggcuccuucaucuuuucaccuguguuucugcuuucacacaccaccacguggaccacugcccucugagcacugauguuuucuugacuccaugcugacucuccucacucauucuuaggggugggcagugacagaggcuucacacgugcuuggaccuggacauuacccaugacaccccaucaccucugagaggccuguuuaacuugaccucccuacaguuagucaucugacucuccaccauguauccaugguaacaucacccucuaccuugucuacuccgaggaaguucuaauaguggccaccccacaauuguucaugugauggccagagugauuguuuuaugcaaauaccaugcucccccacccccauacucaccccauguaccacaucaccuuacuauucuacaucagucucccaauuucuaguuguuccuacuguuaacacaaaacccucaucgugguuuccgggauccuauguggccccaauuguucucucccauuacagguccucuacagacauuuccuuuucugcuggaucuuacacuaccuccagcaauguccuguuaauguguggcugguuugauaaaagaugucuuaauaacacuugucuuuccuggaauacaauaccuccagcaaacuggauucuccaacauaauuaaguuccacucaauguuagguugcaggcagcccauauuccuagaaaugagcccaagcuggacuauagaaggauuucuggcagacagauaaaagccagccuaccucaagaacuuguaacaaaugggguuucugaccccaacagagucacguacuugcguacagcagaagggaacggcucuccgaugacauauaccugugguugcagaauaaagccuacgcuggccuccaggcucccuugguuccuaccugcaagcauuuguuguuuaucucaaagucaccacacuaacaugcuggcccuuuuuaccuccccagccuucccuccuuccagauaccacuuuguucucuaugcaagagcaaggccgaguuuuguuccugccccaacucucucuuacuaucucacugugaccacuguugugucuugcugucaugucucucuaguagauagcccuggccaugucuugucugucucugucucuaccucucucucucccccaagaugacucuucaagaugacucuagauaguaucucucuuauccacaaaaaccaaaauaaaaaacaauuuuacccuaaaaacggagcagucaugugugugcagucucuuugccaugcccccugcacgcucaugaggacuccacagagcccccugaacacuuggaguugugucccuucugcuggaagcaaguaagagacuccuuuuguggacacaagacccauuucuugcaaguccuugaggaaggcuggcuuuuaucggacugccaggaugaacaggccaauaagaggacaugaaugaaucaccaagccagcacuacucuaaaggacaagauaauuccagugaccucaaaagcacacuguaauaaccugaugauguaucagugucauggaaacgugccuucuuguguuuacguuucuaaaucacaucaaaaacaaaugguuuuuuuuuuuugaguucucucucccucccucccucucucucucucucucucucucucucucucucucucucuuaaauccaucuaauuuguucuguuuucaaaagucaggauguggucauuggaagaacaggaguuuuuuaaaaaacuaaaaauaacccauuaauuauggaaucaugauugacauaauguguuuccuugggugcuugguggcaaccgccuuuacccucugagccguccuuccugucucuugcuuuuuuuucuggaucaaucuucacaucuguccugagaaaaaucuacaaccuucagccaucuuuauaucuggagauacaaaggaccagaaggccaggcacaccugugacccuuugcucucccaaagucucugccacuaaugcugggggaggggcaguuuuucaacauggcccucuggauaccugcgggggggggggggaggacauacagagcgcgcuuucuuucuuucuuucuuucuuucuuucuuucuuucuuucuuucuuucuuucuuucuuucuuucuuucuuccuuccuuccuuccuuccuuccuuccuuccuuucuuccuuucuuucuuaagcaagcagcaaaaacaggugccaacugaauggcagugugcaugacugaauggcacaguguucaugugagaagcaacuuacucuacccuggaagaaagucacuuccacauacaguguccuggcaguuucaggaaauguuaaaaacugagagacgaggggguguuauuggugguuuucuuucuucuuucuuuauuccauuccuuccuuccuuucuuuuuuucuuuuuuucuuucuuucaggguggaggguugguuuggguuuucuccaguccauuccaaauguagucaaguugacaaccagaaauagccaucaaaaaugcccagggaaaggacagugaagcuacaucccaagauuuacaauggugacagcuuaauggcaaggaaaaucagcaugaccacaggaguuuuugguaauaacucaccuaaaagagauaaucuacagaguuuaggaaugucaaauuccacugaaaucuacgaaguauacuuuugaaaaauggaacucaagguuuaugaaguaucaugugaauacuauuuuuguaucuauuuuacucuuguuuucuguagcccaggcuggccuuaauggugugggcuucuauuuccacaagcagggugcugggacuagaggcaugugcugccauacccagccuugugugggauuuuaauauguagcuauacugugccaugcucaaccuauggaaagcuuguuuaucucaagaguagaucauguugucaugguaaaggauuccuacaauccucccuuuguuauggagcauuagaauggcagaugacgaguuaucacgagcaacaaccuuaccaugcagggcaacagcaagaccuuaccucuuaccuacagguuagaacuaaguuaucaaaguguaaaauguuuuuauaacauaaaauauuauuaaguaccauucuuuguuauuucuauccgugacugguuuuuuuuuuuuuaagauuuauuuauuuauuauguaaguacacuguagcugucuucugacacaccagaagagggcauccgauuucauuacagauggcugugagccacuaugugguugcugggauuugaacucaggacuuucggaagagcagucagugcucuuaauugccgagccaucucuccagcccccaugauuguuuuuuaaggaccacaaauauauucaaguaagauuugccagccaauaggacccucuccuggaauacaauacuucaagcaaacuggguucuccaacauaauuaaguuucacucaaucuccuuugagagcugaacccuaacagacaguaggggaggagacugcagagaauggcggggaguggggaaaagugcuuccuggacagagugcucugguuuucuagucugcuccacaugccuuugcagaagcagcuggcacacuagccuccagggcagccauuuuacuagccaccuuucuccugccuucagaacacagcuaaucccaucuuuacccagcagacacagcaugccacaucuuaauuguauacagcacacuucccucuguugaacuuuuauccuccagaguugaaaucccaaggcucucaggcacaucgauuucugugucacacacaacuaaccacaaaacccucucagccuccaccauagcucgucagcauggugacugcaaaugccuaacucagcuuucagcaggcgagcucuuuuuaccuuuguuuuggcuuccuguuuauugguguuuuguuuuguuuuguuuccgucuucucaaacgacucagacccuuaaccuguuuguuaaaugcuucucuagcuugcuuuucuucuuggucccauucgucaucuuauuaaccauggccaugacauucuccaaaagaaagagugcaaaaaaggcauuaauaagcccuugaguguaggggugaauugacgugugcacacacggguguguaaaacuggggcaaaaccacaugccaagcaaaagcgagacaggaaugcuaagguauuuuacaucaucaggauuauuaacccaaagcuuuggccauacuucuuuuagucucuaaaguaaauaauaugagucaaaauuguuuucaguaaaaaauaaugcccaggcuugggcugucuuccacagccaggauucuucacaguacugugaggccuuguccuucaucaaagcagaggcgcuaagcagaauccaggcacaggcacggcacuccugugagugagcagauuagauuucuuguucuaagguuaauauuuucuuuuagcuaaaguaucauuuuccacagaccaucuucuauuucauacacacaucauauguaugauacagauuuaaaagacaaauuagccaccaaggaucuucuauuugguaccagaaaacauaaugucuaaucauuugccauucuguuuagaauaaauacccaguuaagcuucagcuaugaaaaauugcaaaagugucacuuugaaggaaauuaaaaaaaaauugaucuaugccucaugccuacgaaggcugcacuacagaagcaagcaacgaagucccucagaucagacccucacuggagaccagggaagaccugugggucaugggcugccaccauuuucuuggauguguggcacaguugugaauaaagcauuaacugaaguuaacuuuugagauccaugaagaauguuacaacuguuuuuuguuuguuuguuuuuacaaauaacauaaacgacaauuuguggggaaauguacuuuauaccuuagacucuggguucgguccucauuucccuucacaucuuugcgucuccguauguaacacguugggaaggcauggggacucgagcauggccauuuuagaggcugagaaagcuucacugagggcucugaggcauggucuucaccaggcacugggguucaucacacauaccagacaggcuguggaaaagaccaggcaaggagucuggggaaaucacuguacacugugggaugagcuucaagaagacgcucaagguuagguacgguggacaauguugaauuuccaguuaaucuggucuuuuauaacuuuaauggguaaauccauccgauuaugaauguuggguuuauucacaaaaauucuggaagaggcaggggacaacaaugucuauaaaguagagauagacauaccuaacaguaugcaucucaggacgaauauucuuugggggaaucugccaacucacucauuccugaagagaccuguagaccaguaguucucacccucaugaugucugucaguaugguaucuccccaccauccagcaagcucgauuugcaauggaacagcauacaucugaacagaguaccagacucacuggucacucuguccccuacucagucaggagaccaucagcugacuuuacaaaguugugauggcuauuccuaguugucaauuugacuacaucuggaaggaacuacaaauccagaaauagaggggggcaucugugauccagaucuuaaagauggaagacacaggcuucugacccagaucuugacauggagaucuugaggcauaguggccaugaaaagcucaggcccgggcacaggaguauacacuuguaaucucaggagacugagguaaggagaucucugagaacaaggucagccugagacagagcaaguccuagauccaggcaugaugguacaugguacacaccuuuaaucugggccacaccuucugcuggaggcuuauguaaggacauuggaagaaggaagauucacucuucuuugacugcuuaaacuuaacugccagcacaucuguuggaaccuacuucuacagaaguucuuaaaacaacuagccucguggaacugagcaacuacuagauucauagucuucccauucacagcugcccauuguugggguaguuggacuacagaccauaaaucauuacaauaaauucccuuaauauauagauagacauuccguaaguucuaugacaacagaaaacccuuacuaguacacaaagggaucaaacuuugggacaaacuguguuaccuagguaaaggaacagcuguacugccuccacaacuucuaucauaggguucccugacauauuuagaugggaacugaccaacugucaugggacuuuguuccauacacgagagcaugacccagcacugugacaacugcguagaucaucauccaaauaggagugacaggucuucauaaacaaaggagcagaaacuccagagaggacaggaacuguuccuuuuaugacagacgucaaaggcacacacugauccuucccugucaacacaggucgguggcacaagccugaaggguugacauggaacacugaauaagccacagaacuuccugaccccuucuacccauaccuccugcaagucugcuccugccuucuuucugcccacuucagccccuuagaucuccagaggcugggcuauuggggccggcggugucauucuaaaagcuacuuuucuucauucuaaagcggagugaggaguuaaaagggaggaacgagguaacuuuuuaaaauugaacacucccaaucuugaauaaacuugaguugucaauuugacguucccucucaauacccuuuaagagcagccguggcacgagacuuuuucaggcauaggaccccacgugauucaucaucagauuccaagcagagugcugggacucagcccacccucuuggauagaucccacccaggaaucuccuaucaacuuacuccucuacucucaaggcaagagacacgcugucccaggcagaaugcaugcaaaguuccaaguccccugucagucccuaaucccuacagugaaagacaccgaggaaccaacuggccacugaaaugucacuggucaaacacuucagcacccugcuggguacagaccagacagagccagcacugugguucccaagacagggauggcagggcggauggcaggcuguucuguccucauugugugcugccgagugagucacacaaaagcaggaaauaauuaaacgucagggaucguugagguaccaugugcaagggcaagggaacagggcgauuucagucccuguagacaaggcggcucucccggcacacuuugcuuuucaaaacaccuucuucaggcacuggguuugugccagagaaaugacugacuuuuaaagcaucucugcuguaaacugcauauucuuuggaaaaccggacgccuguuagcaucaaaggguggggugcggugggccacucucuuuaaaaugccuccaucaaucgggaaaacccucgaaguucucuugcacccaauauuaaccaguuaccaucuccauacaccuuaaagaugagacgaacgcacugcccagaucucagccacagcuguuuauccagugaguuaucagagagacuuguuuuuuauucugcaagcuuuuaggacaguucaaguucaacacacacaaugcuucauucaugcuguuaaauugauaauauuaaccuuucuugcugagaugcauuaaaaacucuggcuuuucagagcaaauguaauuaguucacauuaguaacuucaccagcagcggcgacagaagcaaagugaaugaacaggauacggauuaauguaaucaaaacaucaucuccgaucuugucuguuccucaggcagcuggcuguacuuccucccuugguugaagggguuuuuuuuuuccuccuucuucuucuucuucuuuuaauaaaaacaauagaucaaugaaauggaugucuaacuacugccaugcccccucgggggagugcuguacaggaaacuguuuuggugagugaucccaaaaguuuuuaauuugauaugccugcucaauaccacugugacaauacagaccugcuuccagggcagagggcacugcagaguagagagagagggaagcuacaagcugcacacggguccugggagcgccuauuuccagguacacguguaagucucucauucucuaacacagcgucacuaagagaaaucaaacucucaacgugcgucuuuauauccaaaguggaauucucacacccugaguggcccagcuauguaagauggguggguuuuguugguuuuuguuuuuaaaccuggcaauccucuucaccuuguucagaaccccagguuuccucaagagaaccauuuuguccuuuuccccucucugagucccgggaccccauggccugcgccagcccaucucuagaacacauggguggaaagaauggccacagagcaagaccuagaaaauugcuucugccaucagaacagagcccuugcuuuuugguacugcauccuauguuaaaggaggcacaagacagagccagugaaccuuuugcucccacauggacccuagaaaugaagccaacacacagacaggcaggcaggaccauggagaaccccugacucaccugaggacuguccugagacucugccguuacgagacccaauguuauugucacauaaaccaaugaguuuucuucaugcaacacacguccaacgggccugcaaaacccuacuuggacuugcaggaguagaugagacuuggggcagcuacuucucauggugcaggagggugcguaugcauggggacauuucagugaacagcucccuagucucugaaacccaaggugaacaccugcuacaaccaaucaaaccugccauucgaaguccucagaaccuacuuucaggggcagcggugaagggcagcagcaaacucagguuuacagacagguuguagaaaauuuucacccuauacacuuguuucugccuuaaagggaaauacagaauuaaaaacgacuuuuaaaaaggcaaaacugcacuaagaaaacaauguucuggcucccuaaaguugucaugacccagaaggagccaauacacgcuuuacuucccaccaaucaaggcccuucuagguccucaagggaccuucuggacccuuggauagauacaaagggcaguuaagguucagaguaagaguccccgguuaauccacaagaggcguguaucuaccaaguccccucuucguuuuaaaucacuguuagcaucugacuaagccugaagugacauagguuugggguuggugacuuuacuguuaaauuaaugucacuuuauguaucuuuagagauguaaguucacaugcccuauuggacauacuacauuuucucauugugcuucuuccauaugaaggagaggggaaaaagcacaaaggaaaauaacgagacucaaugcugagcugcuuugauguuuaaaaagaugccuugcuuaugccugagacucgggaaaaaaaaaaguuaaaggcagaauaaaaauguggcaaacccuccaacuuuaggcuaacauaucugagcaaaaugaccaaauggggaacgccugauaccaucgcgcucagucacaaaacccaaguguucuucccauugcaggaaaccuuuacagagaaaaaaaaaaucccaucaggacuaaugcucaugacagaagcaguagcauaguuagugugaauuugaugcacugcuuccugaaucuaaacacugaaaccuacugacagccgaugucugagggccccauggggugggcucauguuaacugcugauaugcacacuucuguugccgcugcgguguguuugugaggacuuccccugagugcaguaucaaccccaguucugacccugcuuguuagcagaucaaauuaacauuaucuggacccaggacuugacaauaaguaaagggaagagaagacagaguauaaauaggaccaaccccuagacugugccucucaacggcaacuuuggguagauuguuugagguccccaucacagugauuucgggaagcaugaguuccucacauccugccuuacaggguggggagucgggggugguaugcuugaauucccaauguucagauugcguuuaccagagaaauccuaaggguuuggggaggaucuagcccucaaaagacacuccagaaggaugggcaagggcauuacaggcucccaaagaaagauuucucugccugagugugguggugguggugguggugguaguggugguggucgucaucguucgccuccuccuccuccucccccuccuccuccccuccuccucccccuuccccucccccuuccccucccguguucccucuuccccaagccuaacaacaccccccuuuucugccuuuggaugaagcacaauggauucuggccauggagauuggaaauuuugaaacguaugaucuaucuaguaugaggucuucaggucacugagauguaccugugaagggauggcagaaucacgcucuuuggccauaaagucaugagcacugccuccccgggcacuccacgguguugugcuucccuuccauggguccaaaacacuuguguucccuagccacuaacccaaacgcccacaauugugagccaaagcaaaggccuucuauuuacaaguugauuuuuccucaaguauuuguuacgggaaccauuuuggcuugaaugagaaugggccccauagguuguuagcugaacguuuggucccuaguugguggaacuaucugggaaggcuuaggaggugugguauuauuggaggagguaguaucugaaguuucaaaagcccaugccaggccuggucucagccucucucugccgccugccuuugaauaagaaugugagcucucugcuccaucuccaguguugugccugugcuauucucaccaggaugaucauggacuaacuuucuggaaacuguaagcaagcauucaauuaaaugcuuucuauuauaagcugccuuggucauggcaucucuucacagcaacagaagagggacuaagacaggagcagaaagcuaauauccccuggagaugucacugaggugggcuccaagucgagugucuaaaguguccuucccuccucucccaggucuguguuuccacaccagcucagccugcacacacagaagauccccaaacaacgcaccaucaguugcucuuuuugucuccugcuccguucuaucucugccuuuuugcaaucccaguuaacagcaccacaccgauggucagcccauuucuuccuguuggugcuuagucauccauccacuggcuccuugauuuucuucccucccauccuuucauucaccaccaucucccaucuaucuuuuucuauacuuaucccagcucacuuacauacuggaagugcugcuuccuguccuuccuugggugacuaucccagaaugguuguagaacacagauaugcugcggcaggcgcuccccugcuucucagucccugucuggaaaguaaggcccggcuuccgagugcaggcaggcacauaggcaguuuccaccagcaaucccacacucacccucaccaguaucuguccacaaugccugaccuuacauucucucuuuguccacucaucuccaucacuucccaucccucgaucccccgaaaacucugcagacuuugagauccugcuccugagugugcccucuccacaccaaccugucccuucuccaggccuuucugggccggcuguucuugcauuaaaaggagcacagggcaguaccauuuguucaccucucagccuccccaccaggccaggaauccccagcagaacucucuacucuuauucaggcucacagagccaaguauagugcucggccccugugagcacaugaauuucuaauuacaguaccacggaccuugagacaaggguguuugucacaaguaagggcugugcuuucauccacgccugccaaccagcaaacguuugugagaaacagaugcagcacgcagaggacccagugaaggagguggggagacugggaggaacaugacugcucacacgcaaucccuucgcuaaguaaagcugggcuucccccaggcaugugauucuagucaacaaguagaaccaaaaucccugccgucggcaaacacacugcucagugucacugccaaccauccaaccauacuucccaacguuuucauucaaacccuggaccaacugggccaccccuauuuaccagucugcaacuuagaugccucuaaccagggagagaacacagauaccuuuaauuacuacccugggcuucagaaguaagagaagcaguccugggcugaaaggaggcacuguccucuaacauauccacaguuaccuucagggaagggggacacagacugagccaacaaccagugcuccccagaaggcacuucccaugugcauaagaaacuccacaucuggccacagaguggaggagcucuagacacucucucaguaaacccaugggagcaauaucaaugaugauuaaucugucaaucccaaccuuugaaaaauguccugggaaaagaacacagaacagaauaaccaaagucaaaugaggggaaaauugaaucgugcuuuaaaugccauucauucuuagagguuaauuauuacacggacagaugauuuauauggccagacaacuagccccuaauaaguaugcacaacgcaacuaaaugucccuucaguuauuaugagcuauagcauuggaaaaaaacaaagauacacauaacccaugccaucuauuuuuacaacacagagccaagagcuacccauaucacuuuuaaugacuggagauuccagaagaauuaucacuaugguaacacuucaaaauggccaucagaguuaccaagcacccguccacaacaguuugaaucugguaacagagcgaguuaguuucaaaauacaucuaaugauuccuaccaaagcucugcuagcucuuagcacagcuaccuacaagcgugaaugaacagaagccacgguacacaaugagcgugcaaauaucaugcuaccauacacaaauaauuuaucaguaaugucacugcaaugucaucucaaaauguauugaaagcauaaaaaaagauuuaaaaauuagccauuguuuuuuguuucuucaauugcugacuuuuaaucauuuuacaagccauuuauauaaauuauccaaaacccaguagaucucuuuuuuuuuuuuuuuuaaggugagcaaacaauaaacuauaaagucccacugggaaucuauacuagaauucuaacauuccucccaguccucuggagguagccaggaagaaacaauuaauucccugggagccucauuuucauaagcaaacaagagggugaccuggaaggucaccgcccuggguaugagaaccugguccucagccaagagacugcaucagagcugggaagggccuuggcaaagugcuuccuaaacaguuccacuggcacgucucgaagaucaccaaagcagcuccuaugaucauuaaagcagaggaagaaaacacuggggcacaaccugggaacuacagguaagugcugcgccaaguaccaaguguucuggaaacacccguucccgcuuuacaguuauuuguuauuauaacuauuauacaguuauuugucucugauguaaaucuuggucuuacuuuggggcugguaaaaaaaaaaauaauaccaauaaacuaugaugucuuguuuucaagagagaugaacuaguguggugaagcuacaugguaucaacgaucuguucagacaggagaagugagugaguccuccucguguuuaaaccuucuuucuauguggcaauaaaauacucaauacaaguauccagauggaugaagccacagacagccguauuuuagaaauuaagggaaccaccaacacaaauucuuuuaacugugccuuuaaaccagaugcccugaaaaugaagccauggugucccuuaauugcaggaucacggaccugcagacacgguguuacaaccgagagccaugucuucccagggaaaccucauucaaagcccacagcauuuucaaggccagucacacauacuucuaagggaagacacacaggcucacacauacugucucaaggacacucugccaaggccuacuguuuggguuccucuagaagaaagugacucccacccaggcgugaaugccugagaaagcccagcuaagucaaggagacccuagcuacugucuccagggagcugagaggucacuaagaccacacacagucugugcucccugaagugaagcugaaaguggggauguccucuagggaaaaacaauaggaagguuugaguucagcuuuguguauguguuugggcuucucucggugcaaagaaacaggaugaacacaaacagggccagaagcccacuuuuccagauaacaccucuggaccuacaaaaaaaaguuaaaagcacacggguuaaaaacauaaacucugccaagaaaauacgagauggacggggaaggucaccacccugugauugcagcuccuugcuacagaagguagagacuauguuuuaggaucucuucuggcaagcuucuaaugaguacgccagcugacaccugauaauucagagacugugccguuugggaucuuuuucacuuaauuuacagaaguauacagagaucucguuuuuacauuuauuuuaugugucuauguguaggcaugugcaccugagugcugcugcccucugauagcuuagguccccuagagcuggaguuacagcagucgugagcugccucaagaggucuggggauagacuguggggccuccacaagaucaguagcuucucuuaaccacugagucaucucuucagaccucaucucaucagccccucaucagauuuaacuuggaaagcaagaagaguuguauaguuaagaaacuuguucuuuggaaccauacacaccugaaagaaacccaaacugcccuacuuuucucuaucuggugcagugguucucgacaguucucaaccuuccuaaugcugugacccuuuaauacaguuccuuauguugugguagcccccaaccauagaauuauuuuucuugcuacuccacaacuguacuuuugcuacuguuaggaacuguaauguaaauaucugugcuucccaauggucuugggugaccccugugaaagacccauuugacccuugaagaggucaccaugugaacugccaaucuaguguauuccuuuuuaaagaauagaauaaaauguggggauuuuauucuuuaauguauaauagugucacagcuauucgcugaagaacugcccccauuucagcaacguucucaggccagucuugccuacucacaguucuuuucaaagggaagggagaggguaucuagaguuagacaccuagugaaucuuccacaggucaguucuguugcucaaaauguuaaguuagaucugauuccuaccaugagaauuuugcugccgccugacagacccaccggagaaaaagaugucaucuaaaaacuguagauuaaaaccgugcuggccaaugcuuaggagcuggcagagcccagggcugacucugccgauggcuccgaggagcagcagcacagaugucugcucugggucagauuuaaagagcuguggcagagcaucccccaucacuaacuccugccugggcucugucccuggaagucuaccguugaucacugaucuaucagcaggcaccaugagaggcaacugagaccaacccagcaccaagccagacccgcucacuagaagcagcaggaaggcggccaaccccagccccguuuuaaggucgcuacaugugggucuacaguacaagaagaacuuaaggugaccugacacucccaccucacccugccagccagccuccuacagacaaacaaaagcauccagugaagacagccacaccggcaggauuucuccucaaacauaagcucuugguaaaauaccuaccuggaguaacuguguguuuacaggucuggaaaggugaagaacagaaauacaguuuaaagugaguuuuuaaaguccuccccagugaauaaagaggccaccucugcuccuaucuccugccucccccacccuccuuugauaggaaaaagacaaaaagagagguaguuuugagucagcuaugauggaucugccacagggccuagagaacuuucugggccaggcagcccuggcccagccugcauucuuuuggggugacagagcacccagcgguuucccuguccuccaaccacugcagcuuggugacuaaguccacaggaauuccagucagugcuagacccacccggaggacaggcagacacaggacaggcagggagggcccucacugcccaggcccuagucaugaagaaaccuacacucuucaguccuuguaugugggaaucagggacauggugguuaggagaagagcccaucugugcucaggugacacccaggaguacaaggcucugcaauagcaucuggguccauacuugggccuuauuucacaacaggucagaaagccaaguuauacauauaccucuguaacucuugaaaagacacccaguaaauguuggugggucugagucggcaaccuggaggucagcuuucacaaguaaaaggcaagaaaguaaacgccagcucauaccaccgaccucagucacuguuccggagcccaauucaggguggaaaccugcaguccagggucugcuuugauaaauuacauccugaggcuuuauauauuuuacuaucugugaugagugauagauaaaaagauagaaaguuuacuguaaaccacaucccuuucuuccucuaccacaaccugccauucaucagagccggaacauccauuuccuuacaauuaaagaauaguuugaaaauaaagucuccccaguuaaaauaaucagccaaacaaaggugcuugaucaaugaucaacaucaaaguuuugccucccaaauaaaaauaaugaaucuauguuuaaaaacaaaaaucaauagugcuuggggaagaggagucagacaaaggcaagcaaggucuuacaacucagagccacgcugccgugcgacuaagcagccauaacuaacgaugcucaggucauucgugaggaagggggacaaggagagacaggugaccaguggcaaggaaggaaggcauggagggacauuagaugaggaaggguagagagauggagagaaggaagagaagguggaccuacagguaaaggaggaggggcaagcaggaggacaccugccaacagaacucugacuguauuuauuaaucacuauggagauucccugccacauaagauauacaaauauacaagccuaaucauccuuaagaauucacccagcagggccucagccuucugccaagcaagagaggccauuaaagucauucccacaagagggcagggcuagagacuuagcuagcugcaagguaccuugcauaacuuaugccaggacucugugcuucaguuuccuggccauggagggaauuggcagugugcugguugguuuucugucaacuggacauaaacccagacguaacugagaaaggggaaaucucuguggaagaacugcugccaucagauuggcuuguggagcauuuucuugauuaaugauuaauacagagagacccagauugcuggggugggguccgccccugagcaaggcgguccugggugauauaagaaagcagguugaauaagccagcaagcagcaucccucuacagcuucagcuucaguucccacccucaggauugaguuccugccucggcuucccuucaugaagugcugcguuugggacauaucaccaaaauaaaugcuuuccuugugaugucgcuauugcuuggguacaaaaauagaaagcaaacuauggcaggcaguauagagaucagaggaaaaaaaaacucuugagcuguguagaaccuggccauugcucaaaagaugccacuccagucauuagacacaguccuuuccuagagaguuaacacagguguucaaaggcagaacuggagccauccagcugugcagacucaugcaaccguuuccacauucugggacccacacccugcuguccacaugugugggggguuaggucaacagggacaagacccaggaaguuuuuggauaugcaguucauugcucagguugcagaaaucugggagacuaacuugggaaaccuccaaaggcaggaggaaucucugcaaagguucugaacaucuuucuucacaaauaguagcccucaaauuagcccccagauuuagaagugaaucucaccucuucuuuucaaaaagcaguggaguaugcaaagaucuugaaaaaggggacaaagauccugaucugaggagacccuguguauugucuggaccgucgggucagugugucaguaaggcuuacucggcugcuccaucuccgcuucagagcagagcgcuugacaggguuaaggacagcugaggcaggugaacugaaggcagcagccgcgaguguucagguucucugguacacgggagguggcucuauccgagccagcguccuuucuggcuuccuaugacucuucuggggaugaaggggacacaugaagcuauuucccagaaagugcuguggaacacagacucuaucacugaacucaacuccaggggcugccuuuuccacugugccaauggcaacacguccuugaauuaccaaaucugcagauacggaagagguuugaaggacccugcugugaaugguaggaggaaggcacagugugcaccuccucuugucuucucucugcccacaaaaugucuucacuuuaccccaggccauggaccccacaggaggaagcaucaucuccuauuuaccaaagcgggagcuagcagacccaacucaccugcgcauaccuguaggccuaaggaagagagagacuggggccuccacucaucaggaaauaaaguucuagguaagaaaaggucacggcgcuuaccuuaggccacauaagcacgaacaagagggcacuugcuaaggccaguggagaaaggauuccugaacuaaagaaguaccaggcaagcaaucagaggcugcuucucacucaccaaaaccgaugccauccuggcaucauccacaucaacuguacucuccugcgucaguccacccuacgucggaaacggccccucaacucuguggucauucuccccucuguaaauccacucuguggucuacaaaaaaagauuuccuacacauaaaugaggaaaaguuguguaggcaaguguuagguggcuggccucgcaccucugccaagcacgcaugcacgcacgcacgcacgcacacagucaauagcccuuguaaauuuacagauuugggauuuauaggcaacacuaugggauaaucugcacagauaaaugucacaaguuaccuguuguaguuuguuccugucugggaauuuaaauauuuauucacauuucuuaucaucuugaaggauaacucuccuauacccccaaaaaggguaaaucugcuucauucucucuauucucucaaaauaguaucaacaguacaguaguuaacugugcgcuggccuaaacucuucucggguguuuuucaacuugcuaauuaauuuuuuuucucacuacuaucauaauagaaaucccaagagaucuuggucuucagggcauaccacgagccagaagaacugcacugaguucucaucuacugccccacuuaauaagcaaauaguuugugugcaugcuuaaaaaacaaaucugaacagguucguaauguagauacugcaagucuccccacaacguuaaagaaggcuucugacuggaguuuacugagcuauuauccaauaaacuccagccugaggaugccagcuuccuccauuagcucagagcagccuggaucauacucuauucuaaauggggcugucccagucuuucaucugucuacuaucucuaucaacaggcaggaaaagcccagcgcuucaaacuccuccauuuuuuccucgcucaaacaacgaccuuucucacuacuuuaucucugccuuaaguaccaggagccgaaagaucaaccaauuuaaucucucucugcccaucuguauguaugacuuguuaguuucagcagauucucauccacaaaucccuccuuugcccauucaugccugcauacuuaacauagauuuaauauuucuccaggccaaugaucacaacuaagaguuucucuuugauuugagagcagaggagacaaaugcagggggugggguggucuggaauaguguuuacagacaacuccauaaagcaagccugcagaagaaaaguugugcaacauuuguaauccagacccugugguuucagacucaaaugcugcugaacacuauacuaacuuucaacuaucauucaacuuucucagcagccuuucauguagagcagaaacgaacccaucuguagacugaaaguccacacuucuuccagcauaaccuucacgaacuuaaguguugguggagauaucccugauucuguucagaauucuccccacugaaugagcagagagccuggaguacugguuuccagcuuccauaaccccugcauuccugcugccccacuccuacaauccucaacaucugggaaaaagucaagcucucagaaggggcuauuguaagggguauaaacaugaaacaaccaguuuccuaccgcuccugccucacccaacagaaauagggcauagaaagcuuugccuuauccucacagaaguaaagcuauggacacuagucagauacaaacgagccaaacaggcucggggggcccaagcagauggagggauccugggauccaaaucaccaacuaaaccucugcuuuuaugucagauacuucacauuccaaacaucuuaaaaucugaagugcaaccuacucaugaauugagagccguguauacagccguguaaacaggagugagccggugcaagcauucuuaagggaagaccucagcuuuaccggaggcaaauaucugguccaaacaaaacuccaaauaccgaccaaacuugcccuccucugaguucuuagcacuuaguaucucuaguucccucucagccaaagcugggauuaccuugccacacaauguaaguugucauccuuuuauacuuugaaggcggagggagggagggagggaggaaggaaaggagggaacucuguagaagccagaggacaacuccagauguuguucuucgggugccuccaccauguuuuccgagaaaagguaucuuauuggccugugauucaccacauaggcuaggcugucuggcaagucagaaaaaccccaaacacccccucucugccccucagaacuguggcucuaagcaggggacuccauacucgcuuuuuuaaugggggucaaacugggguccuaauacuuacaaagcgaacauuuugacuaguaagcugccacccaucccagcaucaugcauuuuuaucuuuaucacccaacaaaauuguaagcuuguguccucucauccugcuugccauggaacucacacuaagcaaggcuaccucaauuaguuagcuacagggggaagaauggaaacuucagccaacuaagggaaaaaaaagugaagauccugcuuagauauuccucaugauucaagccucuucaucuuucuccucauccacaggaguaucaaccucuucucugcuucaucaaugacacugagcugcaaggguagcaaggagcacgaaccuccaaggacccaagacacacauucacucauaaacucuaccauuuaguuggccuauuuaucccagcuaaccauggacaauuuuagccaucugaaaacacuuuauaaaucccuccuuaaaguuucucuaucuaccagaaccagcaggcaaguaagacaagauuacugucuaguuguaaugguuugaaugagaauggccccacaggccccuauuuugaauggccaguccccaguugauggaacuguuugggaaggauuaggaggcguggccuuguugaaggaaguauguugcuggguguggugggaggagccuuuuuaggaauagcucucuuucucucugccuuuugcuuguagaacagauauaagcucucaugcuccagugccaugccuaccugccugcuaccaagccaaguucccuuccaugauggucaugaauucacccucugagagcauacaugccaauaaacucuuuuguuuguaaguugccuuagucuuggugccucuucacgguaauagaaaaguaacuaaaacacuggguuacccaaguucucacucucauacugccaggaggaaguucuaugugccucauccuggucuuaccucuuuucucuccucagccuccaccaucuccugcugagccuccugucuucauuaauaacaaacugcuaaaacacuauauaugguaagggacacauggucagggccacauaauaccuccuccacaggccagccauuggcugugaggcaggaggaacaaaaauauguuauaagcuguuuauuaacucuuuguagagugagguaagggaugacuggacaaggucuuuuuaaccuacugacaaaggauagaaaugaccuucagaaaccacauccucaccagaucuaucccagcacaaccuccaagagcccuuggcaagggagaucuggggaacacuguggacguaagcacucaaggacuggacaacagauaaggggcgaucucguaaacuaccucagcagucaauguuugcucuggcucagaccugcauggcaaacccagaugccuaugagaaaaacacauaacaaaauacacucaacucacaaaccaacaaggaagacuuuccugugcuauaccauuucaacagcacugccaacucugauggcucucaaaagcagcccucuggaaaacagcaauaaucaccgguggacucuucccagguuaucaagcugcuagaugagggacagcugacacuggucuaaaagaaagacuucacugacuuuaaauucauuccacauaaucaaguuucauuggugcuccucggugcucauaaauaauucacuuucauaacagcgaaagccagaccaagaaaaugucacuucaaaaaugcaagacuuaaauguaaauccuaccugaauuuccugcucucaacuucucugaccaucucuccuuauuucugccccauuauggagguauuuugcuagccuucaagccugcuucuagcuccaaaaauacucuugagaacuugggagcuucagccaccuaugggaguucacagccuacuucuaaagccaaucuagagccaacucuuuacaagaggguauaauccaaagaggcuggguagaauaucuaucaucaaucuuagcggcauuugucaaacccccagagcuagcacauccacccuagaccccuaccacccucccugacauuaaaucucaagguuggaagaaaaugcaggacucacugugucaaagguuaagaaaagaggggggagggaaagugacagccuuuguaagucaaaaguugggaagaugcgaccugacucugcacauucuauugucaugcaaaacucccggauccugaggcugccuugugccuuccucuuuuuaccugaucaucccagcaucucagcaucucaucuggcuuaaaugggaaggcacagaggaaggucagguuuguauucauuugaauauauuaucccaaacaaaacuguaauaacaggaguugaagagcucgcaaacagagcacuacuuuuaaaacugucuauaccccaagcuugcuaacagaauccgagcagcccuuaagaagccacucacgagccacucaccuuuaacuugugagcugaaguggggucugaguacaacccugacuaccauuucuuuauaacugacggaacucgucuucugcagcccuuucccuauaaucuagugguucucaaucuuccuaacgcugggacccuuuaauacaguuccucaugcugcggugacuccccaaccauaaaauuaguuuugaugcuacuucauaacuggaauuacuuuacuguucugaauaguaaguagauguauuuuccgaugggccgaggugaccccugugaaaaggccauucaacuccucacccccuaagggguucucaacccucaggcuaagaacccugcuauacucugaggccuuccaagacuuaggguaacagcgcccagcaagaucaagucaugguuuauccaaagaaguucagaagccucccagugagauugggccaccuccaaggucugaaaccuacucaugccaggcaaucaggugaggcucagagacccgcaggcuaagaacugaauacccauaagcccuguauuauuaagggcaugggcaccaaaugccauagucacuauauagcuagcaacaaaccuacagugaaauuaauccugcaagacagacuucuucggcaagguuaggggcucugacuuuuuguccauugucagugugaacagcuucaccccgagcuccagcccaccccuagucgccaucucuggcauccagugacucuuuggaaagauuucuccccccccccccaccccucagcaaacaagaaguguuuguugcgcuacagaaacauucuucagagaaaaguauacauucccagaauuccauucauaaacccguauggccaucgaggccagagcccugcuguguucauaaaguggacagcuaggaagagguaucagcugggggaagagggcaagauccauccgcacugaugugaggaggaggccccucaggcccccuggacaggcugugcaacugugaggaggucuaccaaggaggucuaccgcugggcguuucugcucugcgcuucccuucccgggucugugagggaagcaacacuggauacuuucuggcugcuucugcucugaagcuuccccgauucguuauucagaggcuucugaagggaacagagacacaucacagaauaacccaauuaucucaaacccaccgagagauggaacaaaaaagauuucucuacauccuaucugauaacauuuacucagcaaaguauaaggaggccauucgggggucaaaaagaaauccgagaaaacauccuauggagucaccgccccaggagcagagcuagguuuuccuugucacggggaccugacuggucaccaaccugucuccuuaucacaauccuuccagagaguaggggcaccaggagaccuaauucaaaugcuagaacugcccagaaguguuuguggggggaccaaucaucuucccuuuucuagucuucucuuugggggggggcgcuaugcucuuuguaugcugaucuuuugcccuuuuacuaccaagugcaacccugcagccgcagcugcugaaagaaaacuaugcacuaugaggaaccccaauuugggcaaccugacuccacagaccugcugccaacaggagaugcaucaacuugggauaggggccuccuuccugauagccucaugcucaaguaaacauugucuuauuuaacaacggcuucuaagugcaggaguagugguguuggcaauugcauugcauuacacugcuauaaacuauagcacacugucauuguagcuaaucucuacuccugcccaacuuuuaagcuucauagccuaaggaagggugaauacacacauggcuuuagucaucugcuggaggucauggaauguguaggggaaacuacugugcaacccuagcuacuccauucagcaggauuugcaaagauaaacuugaggcagcuacauacagggucagucugacagcgucucuaaccaaggcugaguaucaagcaaccaagucacuaaacacugacugucucugcugccaucccacguggccccaugggggaaaaaacaaaugacaggaagaagagaggaccgagugcuuguuugugaccaaggcagagggacaacaagcaacuucuguucaagaaugagaagaaccagaagcccugcuuccggaagagggccuggcauuccugcacagcauucucccgcccaccugauccccuggaacggaaggaagagcugagagaggacacagagagccaguguuuguuuccugcaaugagcgagaggagaagaaaaaaacaaaacaaaacaaaacaaaacaaaacaaaacaaccaaacauaacaaagcaggagaggaggccgggugaaaaagccaagacggugguggucugacugcauaugcacacacgcauaaacacacaugcccgaaggaacacucacacacaaacgugcaaaugcaaacgcaugugcgcacacagacguguauacacacagcuauuauuacccaaagaggagcauaaauaggcagaggcuccagccuggagcagauggcugcuaccuucaguaugugagaucugcaguugucaccaauaaaaacgugccuccuuguuuucuuuacuaaaaaccuauacccacucacucucuaaccacuuuaaugcucucagaaggggugggggugggggagucaaaagauaguguuuaaugucaaugucaaacaaaaaucuguugguauuucuuaaauucucccaaauaccaagcuugcaagcagaauaaauucagagucugauaacaaauggagucuacagacaccuauaagguuucucucuaguggcaucuggauagacguauguacgucacugaguguucuuuaaagauauggcuuaucugggcagacaugaaaauuugaacaauuccgauuaaauuagcaagaaccacucguacacuaugcccugcuauuuaugauaacucaauguuugcaauuuaggaaaggcaacagagaaagaccacuuaagggacagcaguacauauacaguuaguucagcuuaaugcucaaaauuuuagagggucuccaaaugcagcuauuuuuaaaacagcagcagcuucugcuguugaccaagaauucacccaaugcuggucagugugcugggggcuuuccggguaccaccugaacaucccuguuuuguggauggcagacaagccuugccuugcugcuccuugucaaaggggaacauucuaccauagggccgagcucagaagagaccccccuuauuaaaccugaaucccugauucacaccaugugcuggaaagagaccccaccacuggccgaacuugaccuuugaaccacgauacaccagagucgagcagugcaguccagaaugagauuagccacagucccaugugcucuauguuagccuuacucuaguugaggaugcuacacuggcaugagaagagcaagauaagaacagaaaugcaaacaaagaaggggguuaucaggaaacaggaagaaaccagaaccaaucuacaaguagccaagagauagaaggggauauauaguauuccucagaaccaaucuacaaguagccaagagauagaaggggauauauaguauucuucagaaaccucaaguucaaaacaaaaccacuaugaagauguccccuuguugccccuucucccgccucucuccacgugcucauggcuggccccucccccucccuuccucuguccaucccugccuuucagucucuacuacccucucaacuccccucccccaugcccugaauaaacucuacucuauacuuuaaaagagagagagagaaagagagaaaaaagcuaacuucuaaaguggauccagaagaaugacagcccagcaaaggccacccagcccaaagcaaagccccucuggaacuaaauacauugcucuaagaacuacagaucacuaggcgguggcacaaacacgugaacacaaacaacugcuuuagcaccucaggaccagggguucgcaaucaggauagaaugcaaucuccacaccaggcuauaaaaggcauauagcaccgaggcccagggcaugugaccccuucuaaauaaagaucacccccacagugggagcagcugaccagaacagaggcguucccggggaauggagacaagcucuuaacacaaugcgaaagccagaggccucuuguucagcucugggucugccuacccaccaugggccaugggccugucucauggucuacaucaugaucucuuuuagcagucuacagcagcuugguggaagacuccacagcauuucuagacauacucugggucuucccagguagcugaagauuaaaaguuaaaguaaaauccugccaaacacauggcuggacucucacagggcaaaaacuccaggggauuuacaacugcuucaacaaacccuuccacuuucuccccaggggacauguucuaccagccugcaaagaaauacaaagggacagggacagggaagcaauucucucuccgccugugcugcccugacgaccaguguuugauaaacaagacuuaagaacggcauggggaagaacaaaacccagaauuaucugguguacaccaccugcccucauuuugagucccuggacccauccagagaugguaacguuuucccguugauaaagggagcagaggaccauccugaagcuccaaucagcaaugaccaugguuccucgguuuuuuuuaggguagagggaaaugcaauaccuugcaugaccacuaccucagccaguggucuuucuaucuggaguaaggcuggcccggcagcuaagcuggcuuccaguguagccaggcucacggcucuguggauuuucuggcaaaggcuagauggggugcugugagccagucacaagcuguugauucuggcgagccaagaggcacucagaggccaaguuuagcagugaggucucaggcuuuacuuuuguuaccuuuuauuugaugucguuuuguuuuuuuggaggagguguccucgcaugaaaucaaauaccagaaaagccucugugucaaagcagcacuuuccguaaauucaccgagaagccagaaaaccacagguacucaggaggugucaccgcugccccuuccaauacaaggccagcuguguacauccuagggaacagcuucuggggccagaagcccagccuuuuuagacuucugcaucuugguccugagaaggggaguucuggugcucuucccgccauuuuggaacuagagaugguuuggaaggacacgcuccucaguagcagugacggugacagggucagaaccacauuuuacgaucuuaccaucuuuaagccugcuggggacuaucacugcauacuguucuuugcuugggggaaaguggaucuucacaaaguaggugccaugcucaccccuggagugcauagauagauacagcuagaagucacagaacacuguuuaaaaggaaaagaaaaaagaaaaaaagaaaaccuaccuuuccaggugcuagguaggacuaguggaggcuccaaagcccuggagucucgugaaaggcaaggcuggagcucaccucagucucagaucugagauggaggaggcagacugguuaauacaaagaugacugggaaaggggggucaaggaugcugccugcaggagugugaggggcaguaaaaugggggcagggggcggcaccaaggagccuacuccuugguuaaggaucuacuccagaagggcaggugaacaacagagccacucaaggcaugggacauucaugggugacaagugaagugggaggacacagagcaggaggcuggagaagcgcaguaucacuguguucacaacggguaggguagagaacggcagagugaagcagaucuugagaugguaagggcuuggauggccuauuagaaaggaagcaggcucgagugguggugcuucugagaugaucguuagcuaggagaacaagagcauugacccccucccccccaacccccgccacggggaggagaguuauguagagaaaccauagaagcaaggagacauuccauggggguggucuucaccuguaguugaaagcucaaauagaagucagggaguggugguacacacccuugauccccagcacuagggaggcagaggcagaagaaucucugaguuugaggccagacuggucuacaaguccaguuaugagacagccagagccacacaaagggggaaaaaaaaggcucagcaagaggccuggacuugagaugguauuugaaagucagauaaagacaagaggaugcuaaggaaccaguaaauauaaugaaguaggaagaagggggagagccugucuguggccaugucuuggucugaaugauuaugucuuccagaacuccuaucccgagaucuagucccugagcacauggugcuaaaaggugaggcuuuguccuuaccucaggaggcuggagcccucacaaguggaauagugcccuugugaaagagacaccagaaaaugccuuaccccuuuccacaugaaagauggugguggagggcucugaacccagaaagcagguccucaucagacagagaaccugucagccccuuuccuugggucucuggucuccagaacuaagagaagugaauccauuguucauaagccauccagcuugugacauucugcuguagcagcccagauggauuaaggccagagacaaugaaagccuagauggagaaaaggccaacagagcagccacuacaggcgaaggaggagacacagaagccauuucaaacaagacaggaggcaaggaccgaccaucaaacaugagggcacugacaguuauucccguauuaauuccccaacacaauuccuuucggggggggggggcccucacucuuucggaacaacucaggccugcauaaaaaucacaaaaacaaagaaauacagagguuguaacagguagaguggccccucguuagugggcugccuccacacugccaguagauacgacccgggaagaaugaagauacauuaugggguaaacugaucaaguggucuccuuuacagcauugacuucacucguauucuucacugggauuucucuccagaugcugauauucccaauccucugccaccagccagcaguaaauaguuuacugggauuccucaaauauucauuuugaauggcguaugugaacucugaagugggcauucugugagggcucgaugcccuugcccuggauccuugaaggaugacggagggcucuggcugaacacagcacgacagaagccaguugucuagggagagccacuaaggccccgcucuccaaaggaaagagaaugccagccaucuguguuguaaacauucuaguggccucaucccgaguaaagagaagcaaaugaacugauuuuaauaaauagcacguuuuaccuuuucgaguauauucaucagagcauggaauccauuuuuuuuuuaaucauguaggcaauauuucaaagauucuucccagacuacauccuggaaacccuucgcucaaagcagggcuuucuuggggcaggccacaagggucaagugcuccacucaggcacgugugacuggugccacuacacacaugacagcauagacuagaauaggagucuacgaagagggaaagcauucuagcugaauuagaaaggcuacaggaagcugugaccaugacuaaguuuucaggacaagguaagaagacaguauucuugaauggagucagcgauuuuaagcacuccauugugaaaccacagaacacgucaucaggacugguacagcggccaaggaaaaggcugcagaacacggccuugggaagaccaguucuagccaacaggcacucuggccucaggccggcuguuuucuuuguucuaauuuaaccuuccauggacucuaugaggaagacaggauccaugccauuaugaagaugaacaaacuaaacccuacacauuuaaauugcuugguaguuccuggcuacuggcccuugacucugacccagaauacaggccuuaucucugccccugacuucuucagaagcugcugaaaagccacagugagagcagagcaucuguggggucgcugacagguguuagcuaaugaugcugcaaaccgcacaucccuuucaugcagagcuucuacgcuuccgaaacacuuuccuguccauacuuaguuuggccaccaugacagagugguguggcugccguaguaccagcucgaccacagcucaggcaagcuggccaguccagucgucacacacucuuguuucuguauccaaaucugaugaugcuuuuuaagauaauuuuuuuucaaaugccaaggcuacuuuaaaaacaaaauguuggggacuggagaaguagcucaguccuuaagaguacuggcugcucucccagaggacccagauuugauuuccagcaucuucagggcucacaaauugacuguaacucuggucuuuccagggacacuacacucauacguggugagcagucauacaugcagacaaaguacucaaacauauuagauaaauaaauaauuuaaaaauaaauaaaaacaaaauuuuaugacaauggacaagaacucauuccuauaaucccaggacuugggaagcuaaggcaggagaugugccaugaacucaaggguagccugagcuacauguccaggcuagccccaacuacagacugagacccuagcucaaaaccaacaaaaagaauuacaggguuuuuuuuuuucaaaccauuaauuaagccaagcauagggaauuguuuuuuaaucaaucagaaaaguauauuucacucagcuauucaaaguacuagccauuagaauacuggcccuacuaauaucucuuauacacacccacacauacaaaugcauacaccuuaccccuacacauuccacagacagacacaaaucaaaugacagaaaacaucaaggugugugaccuacucuggccccaacuccaggcaugaugaaauaauagcuacccaugagggcuggucuuccauuuguugauuauacacacuucagaauuuagacaaauuuauccaucuggggguucugugcgggauuuauggggcaaucuucauaacuagucagguauauggacucauugagucuuuaacuggucuagccauaaaauaacagcuaacgugcugagggaaaccagugaggggaaccuugcuggcaacuacgucuaaauauugcucaauuacugaauucaauacagccaaugcccugagccauagcuacauuuuagccaaaaguugauuuucauguccuaugucacaucagguaugaguuuaggcauucuacaaagaacauaugcauauuacagguaaacaaacaagcuuuaaacaccacuaugagacccuggggucacugcaugcuuuccaaguucucuucacuaagugucugcacaagacugccacaacagguguacgagaaaggaaugaaaacccaagggcucagaaacauucccuccuauagagcugccuuaaguagagaauggaccuaggacucguggaagcuggcaagcaggcaucugaucuaucacguguuucauauuaaacccgauuuccugcagcaucaggguccugagagccaaggaucaccuucucaggacacggguguuaacacguuuccuuuauuugugagaaggaaucuugcucuacaaaaugaugguggugguggugguggugguggugguggugguggguggugauacuauaaaucccuuuacacaaaggacacaggcacugagcuguaagaagugccuguuugucgagaaucagagacuuacaaagcacaccaaguccccuaucucaucagagcaguugacgguuaguaaacuuguagccuccagaugcagcaaauuauuucuaaccagacuugacagcagccacagcagccuccauccaggcuccgguccuguacucugagagaucccgauucacagaaaagcuagauaagacccaucccuccccauccccaggaaacacuuccacuaggcaguguggagaugugagagaacuucguccugccccaccaaagacaaaggagaggaggagggagaggaagaggaagaaagcacggagcagaaaguggaagucccccggcugcccacucuuacuuuucuggcagcgauuugugguccagcagcgguaguuguacucauuguugaugguggucuucucacacaugggcuucuccuccaaugucccuggacacagguccccacauuccuucgggggcuuguuccccacaauguaguuauuggacaccgcauccaagaugagagaccagucuaugguggagagguaacagaggucggcguucuucucaauccugauggccccccgaguaauguuccucagauuauaaagcccaauauccuugagauuggucaucucgaagaugaccagugcguaguuguagaagaguuuccagccacggaugacugugagguuggggaagaggucucccaggcucucgaggccagcgacucggaagagcagcaaguacucagugaugacggugagcuuggggaagcgguagcuucgguaguccucggccuuggagaugagcaggauguggaggaagcccucgaucaccgugcaguuuuccaggcgcuucagcugcugauagucguugcggaugucaaugccgggcccacagacugaagggagacaagagggcaaagcggggcauaugguuaaacagagaucauucuuaagaugacuuucugauagaaccuguaucauuauaaaagaugaugacuguuuuucagggcagagugcacacccgcacagcuaccugguuacugucacucagcugccuacgcuggcccagaugccguacgacauacucacugaccugugggagaaacugcuacaugaaccauccaaacugaagguuucaguccgaggucacaaaggguugugugcagaguucaugcuacaacccgaacgagcccagugucgccaagguccucagucacaacacuacacaaaaaaauccgcagcccagguccuacaguuucugugucuggcaaaaaggacaucaagcaacgaagucuacucaagaagaaucacugcgacccagggagcagacaccauuuaauauagaccaauuggaccuguaaccgggaggcucgaaaaacgcaaauaaaagaaauagcugaagaaaacugaaaggggcgcggguucgcaaaaguaacauaaugugccacguucuuaacagaguaagacguuuccuauacaagugagguaacagcagcagcaguaaaaaucaacagcgaucgcaacagucacagauaaacagccuucaucuaccugcgccaacuguccuuucucugcaaauaauaaaaucaggcacgagcauacccaugcaaagacuuguuucacuuaacuaauacaaacauuuaaccaaucuaauguuuuuccaaaggauuuuuaaaaaagaaaagccaggugccugugggguggcucagcaggaaaaggaagcugauuagcaguccucacuuccaucagaucccuggaacccacugugagugagacaaccccagcacgauccuccccacaugcaugugcgcgcgcccgugcucgcucacucauacacgcacacagacacguacacacaagcgcacgcacacacacaggcgcacuuauuuuccucucucucuuuuuaauuuaaaaggggaaacuuguuuuauuagaguguuuugauuuuggcugucuuaagauuuauuuaauucauauaugugaguacacugucacugucuucagacacaccagaagaaggcaucggauuccauuacagauggucgugaggcaccaugugguugcuaggaacugaacucaggaccucuggaagaacagucagugcucuuaaccgcuaagccaccucucuagcccagagaaacuuguuuuaaauuauuaauacguacuagucccuuguucugauucucuacuguuaauuagucaucucuaauuuuucacauuauaaacaauauuccagauauccaagagcacuuucuuagaacagauccuggaaguagaggaacuagcccaaggcauuugcagauuacaacuuuuuacuuauguauuaauuuuguuucuuugugugugugugugugugugugugugugugugugugucuuuuugguaaaguggucuuaauacuagaacuuuuuguuucauuuuuuuucuuuauuuuugacucugcuaucuguguguacaucuaugcacaugagugcagugcccacggaggccagagggggugucagagucuuugaagcuagaguuacagaaguugagaaucacauaaauuuggaggcuguuuuuaaucacuggaccaucuucuagacucuaaaucuuuuguuuuaaaaagucugaaauguauauggaaagacagccuuggucacuaugcuuucuuagcaucuaauaaucccaaccauuauuaaagcuguucaggagccauaaaguuuucugacccauguaauuaauuaguuugauuccaugggcucauagcaaaagaccaggcacuaagagccauggcaagcaacugucaauauagacaggguaagaugaaaggaacacacagggaaagccuaccaccauuuccaacaggacaaaguagagguagcaucaaagaugggguuuuaagcagccugugauauuauggaagccagagacaggcagggugacaggaggucacggauacaaagagggaucaaaggaaaggaggcugguagaagccuggugagaaggaucucaggaggggaugaacgcuaccucacaggauggagccccucucaaggauccgagaggggagagaagcccaagggaggccuuguauguguguguguguguguggggggggaauccagaacaguggaguggaggaaaggaagcagacauucccuagacaugacagccacugaaggaaggaacugggcaauaucagagggugagguagaaagcagaagagcggacagaacuugagaaucccuuuggucuaauuuccucauuuuucugaagaggaaacagggccccuaagacagaagaaauggcgccacuuccuuggcacugaccuacuccccagcucccacaucuugaucagggaugcugccauguaacuugcuggugcugagaguaaggcuucccaauucagccugccucucaccugcacacacgccaccuaguaacacccgccucuggaauucccuuccaaaccuaguggguucuuaggggcuuuucucauggugaacccccuuuuccucuuugggaugcucacugcucaccuccaagcccaauuguuucccacucgggguacgcccaccuucuugggagccuagcucuaggccuuucuucucaucuucucuccauucugcucacugccaucaugguggcaguuccagaggauggaaaaucauccucuauuuaguucucaaguuuugucuccagaggcuaacacaccacuugauacauggcagacaccagaagacacacacauggagcacaaugaauuguacccugugguggagcuugaguauccuuggcccagaaaguggcacuauuaguaggugugaccuuguugggguagguguggccuuguuggaguagguguggccuuguugugguagguguggcuuuguuggaguagguguggccucauuggaggaaguacgacaaugaaggcacgggcuuugagacccucauucuagcugccuaggagagucaagucuucuccuagcagccuucagaucaagauaucaaaagcucagcuccucuagcgccaugccugccuggaugcuacaaugcuccggccuugaugaugaaggacugaaccugugaaucugucaggcagccccaauuaaauguuguccucuuuaagaguugccuuggucaugguaccucuucacagcaaugaaaacuggaacuaagacaccugauuucaucucugcaacucugauccaaccacugucaucuuuggccugagugacagcaacaucuuccuccaacacaccccucuguccaguccaacccugaccaaauaccaagucaacaggauucuguaagaguucaggcccaucuccuucugucucaucuuagcacaucuuugcuuagcacacuuguucacuaccuccaacaggcucagcuccucccuuucauggccugcugccuuuauagugcuccccuucacacuaccuugauaggacuccccuucacacuaccccauucucucuuugggcccagagaggugcuugcucugugcuaaugccugagcuucaacaguuccccaacucuucuucagcuccccucuucucccccaagccucaucucuccacuucauguuuacccagccucugcucaaugacucaaagcccacgagaauaauggcaccaaaucacucgucagaaaucgagugcccagucuaaaauaucuuacuccuccuauaccacuguaaauuaaguguauuaauuugcucuuagacuuuacaggaguauugaacuacaucacuguauucaacauguguuugaccauaucauaaaaguauuaugugucaaguaauuugguauuuuacccaacaaaucauaaaaguucaggaccaagugaagaaacagagagaaagagacauaauauagugucuuucacaugcagucaguacaaagacaguacgaagggccuguuacccucugccagcuggccucaugucacacagagcugggacuggaagcgucuuagaaugaaagagccauuuccuuauuuacaccccucauucccauuuauagaacaaaggaaaaaaauagggagaaacuacccccuuguuccggaagagaagacgagcccaagccacaaaauacaaggcagggcccagcagccagcugcuuugaauucugaccgacacugcuggucuuuggguguuuugugacagaaaaagagagcaaucaagcuggacugugaaugauaguacgguguucaaaggcacaagccgcaaacaggaaagcaaaugucccacgccugccugucaaagaauccacgcacuggagaaagcacuggaaggcacgugaagcugacacgcccucugcucacagcuggcagagucaggccugaaacacucucucccuuucaaagccaacagauacuuggcacaccccaaagagaccccaacacuugcuuucaggauauaagauagauguaaacauguaagaucccagguggccugcaaagaauaguaaaaacacauggaaaugaagauccccuggaacagggagaaagggcaguguuaggaggagcugaaggaggaccccugcugcaggguccaaccuaggaaugaggacagcagaagcaaaaacgaugggaggccaccaggcaggagcaugccacccaggcuaaaaauucauuucugccaagaugacaucuuaaauaaagcuuuucaggugcaagagucaagucuuuccaaaaauuccuagguauguccuaaaaguuaacuggcagaacuuuuguucugccaaacucaacucuacggacuuggaacaccaaucccuaagagcuucuauuaggagcaaggcugaugggaaauaucugacugagaaaaccuuccaaagcuggauaucugaacgucugcgugagcuuuccauguucagcaucugcccugcgcaaggcaccaugggguccuggaaagugacaaagcgcuuaacugggguuugaauccuagaaaacccuuuggaaugucuucuguuggcucgugcccucaaaaggacaaacaccaccucuaagccucaacuguaaaaccuguaaaacaggcuacugcuaccacagugacgucaggcaaguucugggucacuguccucagggguauguaugcugaaggcuacaucacugagaaagcauuagugaccccuccauucucuuaccccaaucuaaauauugcuaaucugaugaagagaaaggaagcuggcaaaacagcaggcuaaucuaucaacaacaacaacaacaacacacacacaaagaauaucauguuauccauuuaacaaaaauguuuucaauuucgaucaacuuuccuucagacagucuugguuuauggucggaaacaacagauacagagcagaaucagaaucuuguguugacuaugggucaauggacuaaagacacauuggggaacuaacuccaguucugagagugagacccaacacaacaaagcuuuugccuugugaaagaagcccaguguggcuuagccaguggcucgcccacaauagucacaucucaaaaaaaaaaaaaaaaaaaaaaaaaaaaaagaauccacugguaccaguaacuaagugaacaaaaaccacuucuagaugccaucauuuuguuagucaaaauggcaggggaucacugucaaugaacuuugcacaggagaguaaacaaacaacccuuucuccaguaacugcugagcugauggggaaaauauccugccgugcaaugggcaggacucugggaccauagagaaagaggcucacagcucucucacgcuaaaggggccuggaagauggcucaggaggggaucccugaagaugguccugccauacuuucuguuucuaggaccccaaaugaggucuaacagaguguaaggggaaggcuucccgggcaguccuggagccagugugaagcugagugggucgugguggcagcuugagggaaccaaccccaggcaggggugcaguagcuggaguagaggaaaaguaaggauuuaggcagaacagaggcuagaaaacagacagagacauggcacucaaagggcccccccgcuuuguucugcaugggagacaggcauucaaaggccccagcacucaguagagcucaguagaacagcgcucaguagagcucaguuacaccuagcaaggaggcuugcuaaaucacaaagugguccuaaaaucugcaucugagaaauuccacaugcugauuuugauguuucagcuaccauucucugagacacaaggagacccaggaaagacgugaucccaccuuguuacuaccccaccccaccccacccccccuccccuccccuccccuccccuucccugcccuccccuccucucucugcacccaccaagaucugcagugugacccauggaaaaaccuaugugcauguauauauucccuccuucccucucuccuucccucccucccuccuuucccucccucccucccucccucccucccucccuccuuucccuccccccuccaugugugucccaugcacuugauuaugcagguacacauaccugugccugcacauagaggaagcagaggauugucuucuacuguuucccaccuuauugccuucagagagguucucagugagccccaaacuugccauuugggccaaguuagcuggccauggaacuccuggacuccacaaccuccccauucuccaaugugagguuccagguacaugcagccauaccuguuuuuguuguucuuauguuuugcuuugacccuacugcuugggacucuaacacaggcaggucuccauaauuguauggcaaguguuuuuuacccacugagucaggagcugagaaaaauaacccauaucauauagacaaugcagaaaacacacaaagaccaaggggggcgaauccacaguccucccacagcagcugauuagccugagagcaccaucccagagcucugagaagaggaccucucccugcuguaaacuguaacuagccaggaaaccagacaggaggggggagaguguuaugguaacaagcacgagugauacuccaguuugucagaggagaauuucugugucgaguguaaacagacacaauucauguuaagccuuuuaucuucaugugucaacgcagacauguuuacacuguauauguacauuucucuuucacacagacaagacagcccggccaccugacauagucaauaagugagggcaacggcaggaauguaagggauuuccaugacaugggugacuuugagaacagaaauuaaaauaaaacaguguaaucugaaugugcaaauuguucuuugcugcccgacagaagagcugucucaccauagaaacaaucuaaaaaucuaugcccacaaaaaaaaaaaaaaaaaaaaaauugcagcccugaacccuggggacacugaaaccaaggcaaggaauuuacagagacugaugugacguuuuuuauccuauccugccaauuaagaagugggaaauuuacagggaauuaguuccaaggcaaaagaacacgcacgcguguccccuccacguaaggcaucuggagacaaacagaucugugcagaacgaaguggggcucacuucugcacaagggcagcuguuuuuacagaucgucauaaaaacaaccuggccugcucagagauuugacaugccauucucgucuuaacauacccagaaaguccaggacucaaggugcuuguucuuuaaaauaacacccuuggaaaugguucgaaaccuuucuuauuaucuccacucccuaugauuggcauuucauaaaaaaaacagcauacagggcccagucccugccaugccacaccuggugggggggcccagagaagcaguguucugccucccuaugaggcauuccccaggacugagccucagcagggcauaugucuucauguucaccuuguacuacgaacagugaacuauacugccagaagcugguguugggacuggggggggggggugucggggugucuuugaggagcagccaagccagaacaagcccccacugaguaugggccugcagagaaacccugcagagauacaccccuccuuuccuuuucuuucucugacuugcgauuuucugcucagaagcaggcaggcaagcauucuccgugaagguugucccucuguccucccauacccacgcacgcuggcuuuggcugucagaccgguuacaucuuucugcuuacaggccacgugcucaugcucacuccuucagugucuuacuucgcccuacaaaguuccaguauccuuaagugaccugagcuuguguugaugaaccaguuaccgauaucuagcugauagucaggguggaaaccacauucacucacauguuccuccuacccuaggaagugguucuccauggugugucaaguuauaagccuugggcuaggggaccuaauucaguggaacagcccuugccuggcaugcacaggacccugggcuccauccccauguguggcuaauaauaauaauaaaaaaacaugucuaaauauacauauaaagugugugugugugugugugugugugugugugugugugugugugugcacggucauauacaagccugucugaaccuccugaagcauagagcuucugacuuggugacuguuagagugauccugagucccccacagccauacagauggacugaaaccagccacucucacucaaggccucaaguuuuucucauggcuuagaugcagguuugggacuaaauuuauuaauucuuccaauacaaauguaagcaaugcuuauuacaagcuaagugcuacccauaugcugggaacucagcagugacaacuuuagacuucgugaaguggccauccuggcagaaaugaaagcccacccacccgugacaagguuuucugugcuuucugcaguaacgacacagaggcacugccacgggcuugcugcacacucacaccgggcuaagggcccucuauguagacaaauaaacugcgagauacgauagaauacaagucugagauaacagagauaaaaucauuaagcagguacugaaaucuuaaccuaaccaaaccucaggaagauaagucccugcaauuaggcagcugaugucaagacugugggggacagagacagacaacagaagcaagucaaaagcaggaugugugugugugugugugugugugugugugugugugcgugugugcgcgggaguuugccagaaagacacagagacagaaacagagaagaggaaaagagaaugagaacacagggagaggcaggccagaccagcaacaagagcacccagaagacacucaaguuuaagggggaaacuugcauggcaagagccucaaccucuacaaggcaauggcaaggaacccacuguaggugcugaggcacaaacccuagauaaauaugaagugugaaacagcaguaaccaacccaaaguacauggaccacacauccauaggucuaggagaguccaguggggugggaggcagguuuggccacagccuuaccacagugcaaacacacaggugcagagaccccaggcagagaccccacaagaguccugcacugacucaccaaggagauaaguucuaaacacgcggcuggcaaacuggcaaacauacugaaguaccuaggcgucugcacccaucucucuggaucaggcagaagccacaacaccacauggaacucaccaucuuugcaaacuaaacuguaacgugucacuaucugguaugacugaaggacagaaugacacccccuaccacugaccccuaccuguugacuuuaugcauuuguggguuguuuuccuaaacacgggucuaucugaaugucaacacugcucuugccuuguaaaguaucauggaaagggggauccuauagcuccaaccugcccacuccuacuacuccuuccuucccuggucuccaucauccucaccucaccuagucacgugauggccuuuguuaucuccugcaacuucugcauugacugcuuugcucugucaccuccggacaacccacuuuugagugguacuguuuugcauucuccaauuaucuagaggauggugugaaccccuaauuucuucagaggcaagcuguacucacuaagaccaaacauucucagaauuuaggauuucuccacgaaauggagaaggcuccauucaccaggccaaacaacccacaagcucugcucccagcauccuccaggagaagauaucugaaaccaaugcccaccuagguucucagaucaucucaacaccuuguacaugagcccaaacaugagaguaauaucuccuuacgugcauccuugaaccaucaucaaccaaaggcugaacuggaagaagcauacugauggagaaucaagucaugggccaugguccacaagcuagcauagacaccacagcagguaaggacucugucuuguaucuuucccuucccugacaaaguggcuguuuccaagaucacaugcuuugucuacagagcuacguaaaacaaucucaucacaucccugcugacagaaugaggcaaggagaacugcauuccaauggcucaguaacaguccgaagugcugauugacuaagggacaguagaagaagggccaugaugcuccuucugagucauaucuacuucagcauuacuaucaguaacaucaccaauaaugcuaauaaaaugucccucuaaucagggacaaguuuccaggggagauagcaacugcaccggaugacagagucaagaacuaaaaaagaucaacagauuggaacugcaacagagaggaaauaauauuauuuggacaugggugcaaaaaagaaaugugcaaauguaggaggugugaaaaagacuuaggcaacuuaauuagauauaauuucuguaugugaugaugggguguugugccugcacccccaaaaagucaagacaaucuuaggugauaccuaagugguccuuaguagaauaagagauggcagaagagacccccaaguucuggguuuguuccugccucaauacuuuugacaggcaagaagggguggaaaccagaaagccugucacaaggcacagcuacagauacuaagcaugucaggacccuagggagggcugguugggucucauguggccugcugggaagagcagaccaaggguuuuagccaacacacacggacagacucauuguaaagcauacuacacucccuuaaaggugaugagcguuucuacgauguagcccaguucugaaacuucauaagccugacugcauugacacugagacucuugggcucuuauuugccuugguuuuaagacuuauuuuuacuuuacauguauguauauaugagagccuguguauuuauauguaccacauauaugucugguacccaaagaggucagaagacggagucauaucccccuggaacuggaguuacacaugguuugugagcugucuggggaccaaaccuggguccucugcaaaaacaguaagggcucuuaaccgaugugccaucuucagcccuuuaucugccuuguuuuauaucaaagaaaacagaacguaaauuaggaccauguggccugucagggaucacacugguaugggggaggggaaaggacaaggacuuaaaucuaaauuacugcgugcaguuuuacaguauucuuguuuaaagagaugucucgcgguugaaaaggauguuacuuccagguacagagggcugaggagggacugucauaccguguaccaagagccaucugaucaguguaggcacuuucauauggugccugguagaccucugucaagucccucaugaucccucaaagaaagauacuaugaaaagcaagguuccaucuccuccuugucagcccguaugugaaaggcugccccuuaaaagcauguguuuccaccaauaaaaaugugcaacagcagaaaccauagcccauaggaagacaugaagacagaaagcacacgacaacacaaccuaaccacaagaacucugcaggcauccuucgagggcagagcaucucucaggaacuucaagcccaugacuccagcauccgcaggcaucugccauucacuccccagcucuaucaaaucacauccccuucucaaucucaacccccaagcagacagcugcuuccacacagcacuuagaugauaccauucaaauuucccucugcaaggccuggagaagcuggccucccugauuucacugcacguucuuccuuugaugcuggcauucagauuauaugaagagccccugacaguaagaccuaccacccaccaguggggccagcaaaacggaucagugaggaaaggugcuugccguacaagccuggugaccugauuucaaucacuggaacccuuguaaagauggaaggagagacguaacuguccaaagucauccugugaccuccccuccacauguacacacacacagccuccacacauacauacagacaaaacauacaucacauauaacacacgacagagagacagagacggggguggggggagagacagagacagagagagagagagaaccugaagaguuuuugguuuuuaaaaagagagagggcugggugugguggcgcacaccuuuaaucccagcacuugggaggcagaggcaggaggauuucuggguucaaagccagccuggucuacaaagugaguuccaggacagccaggacuauacagagaaacccugucucgaaaaaacaaaaacaaaacaaaaaauaaagagagaggaggagagagggagagagggagagagggggagagggggagaaggaggggggaggggaggggaggagaggagagggggaggggaagggagagggaaccugaagaguuuuugguuuuuaaguuaccaguagagauuuaaugguuuaguagguaacacacuugccauucaauugagaggccuagagugcagauugcaagcacugaguuaagaaagggaggggggcagacaugggagcugccuguuacuccaacaccaggcaagcagacagagcaggguagcuaaguagacugacugccgcugaugagcccugccuccacgagacgggggcugcaguaaauaaagugcagaaugaucauggaaggcaugugauacaaacuuugggacuccauacccacauauuuguauauagcaguguacccacaggcaugugaacacacaugcauacagacagacacacccccucuccaugcauauauacaugugcaaaaaaaaaaaaaaaaaagccaccccaaaggccacauguuuuuuuuuuuggaaaucaacaaguacaguuuaacauuuuuuuaggguuguuuuguuauuguugguuuuuguuuuguuuuugguuguuguuguuguuguuuucuuauagguguuguggauauggaugugccugcuuccuguagcauccagaagaggguaccagaucuccugaaacuagaguuagagguacuugugaacuacccggugugguucugggaaccaaucccugguccucugcaagagcagcgaaugccccuaacauggccaucucuuuggccccugggugguauuguucuauuuguugucuuuacagguucugacugagaauaauauaauucucaaguacauggagugcucugaugaucucaagcaagcuuucccuucaaagcuacccugccucagugagaugccaggcuaguaccaacuccuucaacuaagcaggcaggagacccugaucacagacugggguccuuagacaagaaaacuagccuggccacacacaguugcuaauucagagaggcagccaaaguccccaaagccacaacacacaacaaauggggaccuaaaagucuccuauaggcuugcucggauggaagagggggccggcaucucaacuugguagguuccugagugagaccagaguccagcgcagagcaggugcacaugaauacuuggugccgguaugucugcgaggacccaacucaggcaucuagcaaccacccaacuuuguuucccucucuuaccuuagcagggccacgguguuaauuugcuuaaaaguuaaaggugaguacaccauauugucaauaaacaguuaugcaaaaccaaaccaaaugcugggaaugcaaaaguaucuagcuuaagugcuaaacaaagggugcuucuugguagcagauagcagggacugugacuuaagaugagcucagcugagcagaucuaagcucagcucucucaagagagaaacucucccacuuccuccucuuuuggauaauaaagggacagccuggaagaacuccaccccggcugaggagcucagaaaauugcacaucauucuacagaggaacaaacgaaucccugcuaggcagagaaagcccagaaggacagcugugcucaggaagcagagggcuuuggagaccacuaagccuguguguacaacucuugcauguauggcucuugcagaagacagcagcaucccugcuuaggagcuauguguaucagccucuacaaggaacuugccuggaacaaaacucuaggugcaggaccaggagaucucucagcaauggagaagucucaaacaacagucgcuccuccguacaagagguacuaagucuuguccugccgcaugcacuugguaccacaagcacaucaaggucaacacucacugcccaucgucaacaccaccucuaugccugcuguucucugcucagucucagacaggaccaauagugaugggccccugagccagccgcagcucacacagaccucaaggaugcuggcacgggaucagccaggagggcuggaggugagcauaggaagcugugaggaccacccagccccaguaaggaaacaccaaagccaagcuccaugugagccucaaguucuuccaucaaagcugggggcaaacagcacacagggcaaagggauaucugacccuggaaacuaaagaguagggucuccuagcguaugucuacccagccuccccucacccugaaucucucuugaugcuggauaacgaguuuguuccguccccaguguccucaccaucaaugauaugcuccucuaugaagcauugaacagaaaauaacaggcuugaggcucagaagauggcucagugaguaaagcgcuugcugcaaaaccugagugcuucggucugauccacagcacccauggaauaaagccaggcaggagugacacgcaauuauagccccagugcuggggacccaaggcuugcuagccagagagcgaaucugaacugaugagcuccgggugcccuaagaaaccccgucucuuaaguuaugguaaagcagagguugaggaagacucaaccucuggcccccauccacaugcuaacacgugugcacaaaaccacgcaugaacacacauguauucauaacacacagagaaagagagaaaacagguucacacuaacacuacaguuaaacgguagggccaaugaccaaagguaacacagcagguaugugcugugggaaagaacucugagauaaaggcuugguuccuugaguagauccucguuuggagcguauuuuuaccagagcuucguacuaaacagguguuucccaaaugucacuggaggcuccuguucucgccuucaucucacguuaagguuuccgggguaugggguacgccucucgcaaugagaagaauguaaaauaagauguuuuucacuuacugaacuuacaggaagaaauuacagaucuaacaguaccauucuugggcauggugucggggccgcagcaguucucuuccggugggugcacacagccauuugggaggacacauccaucggucauuccccacgcccacucuccugauucauuuuagcuucucuuccacggaugccauucucgcacagguuggaugaaaaggaaggcacacuugacaguaucccaaaggaucugacuuauaaaaacccaaauccuuuuuaaagacauugcaagggaacacggcaguuacaaagaauggggacugugcagcuggcuucugugagcuucauccugggaucaaugucaacacaccugaagggagguacuuuggcagggccguucccacaacacagugggacgagaaacaugucggcucugcuccuuaagccucauauuuccccuuaauccuaugaacgccauuagacaaauucaaacuaagggacauaaaaccuggccagugcuccuuaaaacuaucaccauggccaaggaggacagagagcuaaaacacugucacaggcucagagauggccgagaggacguaacagcuaaagguaacauggagagguguccugcaggagaccucugccagcaaaguagcaaugcccuggagagagcucaaaggaagacgccgaguucagcucacucacaggcuguggugacauagggugcuggcagagaaggcaguuacaguguacaggagaacgcugugcuaccaaaacacucuuucuguaagccccacucuguucuaaaagaaagucuacuuaagaaggcagagcaaggaggcuugugugcacaggagagcaggccucaaggacagcaaugaugauguccuuuuuuuuuaaaaagaaauaucauuauucucucucugcaguuuccuucucgacacccccugcguggacacugaccaacuggcagcucccuccgcagagcggcagggagaggagagggcaggccaccacucucaacucugugauuccguacugcucgcuuuaacucaggagcacgcggcuguauuccucguaacacucaaagccaauucaagaacaaagaucauccuacuggaggaagagagccaagacacauuaauuugaaaaauuacaaaacauaaauuuguucuuaaauagagcaggacacagcaugcuugcucugcauaaagacguauuguaaagccugccuucugggagcagcagagauggaggaagaguuggaggaagaggaggagcagcagggggcuugguguucuuacuaccuucuguuuaaguacuuuaccaccguauuuuuucaauaaccgucaucaucaaaacgaucacgaaucuuuauaauuuauuacuugccucuuccaccuccuuaacccccaaaccucacccaauggagccaacaggaauuuuggaacucugcuucuaaagccaggauaugcgauguuccuucugcccuaguuuccuggucaugaggaugagcacaagggauauaacugcccuccaggguggccuguccuucgcucacacugcuggcugguagcagcaucuacgaaacaugguccgcucucaguaccugcacuaccaccugucgaagcauccagaaaggcccaugugaugugucaugugcucaacagcccccauccgcaguggcagagagcacuagggaacaagccugccuucugagucgucaaaggaggcagcccuucuggauacggucuaauccuuuaacauuuccugauuaaucaaucagcugauuacaaauccccggagccucaaccacagcguguaaaaaucuaauacaaccaaccaaagcugcucuccuugacagggauacaagaaaggauacgcacuguaagccaugcagagagcgcaacagcacaaugaagaugaagaauggcucuuccauuguugcuuuuaagaucaagugauuucauuucacuaacauugauuucugcugggugauuuaauuucccuaacacugacugagcuucuguuuacuugaugcgaacaucugggcagcgaacacucucacccacccugcagaggaggagcuggccugugaggcuguccggucggcacggacgggagaaccaagcacaguuggcgaaaggggaacccccagaguugaucuacaguucuuucuaagguccuggauccccugggacaucucauaaaagcuucacccuuucuccuaacauguacaaggcauuaauaucacacuggaaaggucugugugaccuucaggcuguaagcaucugugaugccauuuuccauaugaguaaacugacaccaggagugagaguaucuaaguucucccacuaaccagcaggggaguggcaaaacaaaacaacccugaucucccgacaacagacagagggacacagguuaucagugacccacugaaaaggcugugaagccaccugaggcuucacauccacaugcuccccagaaguccuuuauccugacaccuaucuucggggaugccagccuucgagccucaccucagggccauggggccccagccucucucuccugaaugugagcggugaugacuacuggaauggggucgaccagguaagcuaggacuacacacuuguuauucucugccccaagggccugagaaugcugggugcugagugaauacuggccagcggggcuaacugcuguccacacagaggagcauucuccucucaacuccuccuucccaaacccucagguuuccgcccguuuacaccgacaaaaauuugaaauacuggacucacgguugggcucacucacaagcauguguggauguuuugcucaauucccaacaccacagaaagggggaggguagagaaaggggagauuacaaaauaaguaacauggcaguuccucaaaaaucuacaaguagagcuaccauaugaccccaccacaucuggagauacaccccgccccccaaagccucaaagcagaaacuugaaaagcuauuguuaugucaugcuuauaggaacauuacugauaagcaccaaucuggggagccacccaagcaccccaaagauaaguggguaagcauuaacugccauguguaggaauguggcacaggcccacuguuuacuggaguaucacuccaacucacaacaaagcucucacacaaagggugggcccugagaacaguacacagagaaaaguaagacagacacaaaaggcaaagacuaugacuccacuucucugaggugacuaagugcagucuuagagacacaaagaaugguggcugccaggacaaaugauggacagacagacggacagaaggaaggaggaacugguguuacuggagguucugucugagaaacugauaaaagcccuggagauggguggggguauaugcaauguacucuaagcuacuggacuuugcacuucaaaacgacgcaacauagaugcgacguuggcagccugcauauugcuuagcacacacaaagcccuggguucaguucccagcgccauuuaaacaaaguaucacucaccuacaaucuuaaagggaagugaaagauaaugauaaauuguuaccauuuaaaaaccaaauuaaguuuuaagccaggcauccugguccaccgcagaaggaggaggauuagaaguuugaggcucacucaagcucucaccuuucuuauucucuagcucuccuccucucuuucccuuccccccucucuccacuuggccauggccgcccucucucuuucuaccuucucuuuuucucucugccuuucuacaauaaagcucuaaaaccauuaaaaaaaaaaaaaguuugaggcuuuccagugaaggucuccaaaaacuccaaagaaaacucaaauguuaaugaaacaucaaaauaaacucacaccugaauaguaccuuccccuguuacucuaaaguaaggcuguaggcaguuuuagacucuaggaguugcccuaucaucuaaggaagccauagcuccaagacuuggaucagccugaggaggggagccccaccaauauaaccaccgcgaacaccucauacauacaccucacacauacugucuuccagucacuuuggugaagugaguuggggaagcaucuuuagcgagacaauggacaacaauccgcagauacagacucuagauaagccacuguggggcaggggcuuguagcugagcuccugagaaagaaguauccaacuggguaugaaggaaccuguaggcagaugucaacuccacggaaaccgcuguaccauaucuagaggccauccuuuggcuaguuacaccucauaggggacacagaggggccaauuccaggagcgacagaacucaacauugcugggccucgucuaccagccaacauuucuacagauuucucagaaaucaugugaucacuguucuuaaaagucaauaguucaaauugaaaauuaaauacaauuuugaaacgcuaggaaccaauauugagaaauccaaugcucuaggcaagaguauggaacgggagagaaauguuaacuacgcucacucugguuuacauuuagcuuuguaauuugauuccucaugacauguggucuuggaaauuauuaagaugaauuugcaauucucaaauuauguuaacaaauggcaugcaaucacaagcagagaggcaggacaaaaaucaaaacuacgaaaaaagucaguauagggucgaucucauauucgaagaaacaauucauggaaacaccacuucucuuugguuaacaaaauucacacuuaaauuccuuaaucaagagugauguaucguuaucuaacuuuaaacaucuuuagguugcuuagcucguguuuaauaccuaacacaauguaaugcuacguaaauaguccuuacucuauacaguucaggaacugacacagagaaugucugugcuguucauaaagauguacuuuuuaaaaagaauuaucucagucugacguuaguagaaugugccauuguagaagcagugggugcagagggcugacuguauaugguucuaauaaaacgaggucaaacuucucauaaaggauagcaaauaccuaauguuauuugcucaaaucauagccaccaaggacgagcauuggacagauugagaagccagacugccaacaaccacaaacucuccuggcgcacagagggaagguuuccgcuccuccaguaucuccaaacugcaacacugcaacaucccaacaaccaaauucaccuagcuuuaacaaagagagaaacaaaggucccguggucaucugauacauucuugcuaugucugcaaaacguucagaagacagccaccgaagggucucugcucaggcuguguuaggcauuauuauucaauaaaccacaguguaggacacugccagucuuaaucucucacuguaaaggcagcguccuggcugaauagguuucuucuucuccauuucgauuucuagguuucauuuguauucaucaggcccccccaccccagcuccccaccauaaagcauaaagcaagcagggcuacacuguaaggcacaaccagaguagguggcauauuaugauaaacaaggaugacaauacaacauuuuuccagcugugauaaacauauuuaagaucuaucauagaagcugcuaguacuaacacugaaaacuaugaaaauuacaaguuguuuauaauacaguauuuaugucuuagaagcuuuuuuuuucuuagacagaagucgucucacugggagaccauuuccuuaccuuuuuaaagucagaacuuuuuuuuuuuuuugagacuuucugagccugucaaaacacccccaagugauuugauaacuggcucaaccuagccugaggacaaacacugaccuacccaaucuacucugagggccagcuggccaagaugcccgugcacagggcaacccugucagccugaggaggaucccaaagaaugcacccacggacagggucagaacacagaccucucaaacacugcacacaugugguucaauuaucagcugucagagacucccaauaaauuaaaaacaagggugaacuacacccagauuuccaaauacccauggccuucgugcccugacuuggccucuggaacucuccaguucuaugcagacucuuccuuccccagcuuaaaaaagaaaaaagaaaaaaaagaaaaaaaaacccagaaacuuucaacaauaaaccuuaccaucuggcugugagagaggagacuguacaacuagcccgugagaugagcuagcccaaaagggcauucacuugccugcacuccacaaugucccuaacaucuccccuccacccaaaauggacgcccucugcguagcccuggcuguccuucaacucaaagauccaccugccucugccucccuccccagugcugggguuaaaguccuguugcaccaccaccacugggcuaacaucuuuuuuagaaaguuccaccaacaaaaauuuuccuaacaaacuaaacucuuguguauuacacuaagcagagcuaagaugaccccaauccuuaagaaccucucugcaaagcccaagggauucuccagagccuucucgucuucacacaagaacacccccaccccccacccccaggggacagagcacaacuggagaccagugaaacacucagcgugcuacacaguacuugaauccuaaguaaacauauagaccaucugagcaauuacaaacauguuuucauaaaacaaacuguagcuccauuccaagugccauacucaaauuagaucucuuuuuaaagccaugugucucaaucugcaguccagcuguuuuaaugaauaccugcuauguggcagguacuuuguuggcugcuuaauauauaauuaauaauaauaucaauauaauaaauaaugaacaucuuccaugcuuuuaaagaaagcagaagacauggccuacuaucccagcaccccacggucggucaguauacccagccuuuuauacuacacauucuagugggcagguagaccaccugugggcugguagccuaguuuguuuucuaugucugugauaaauaccaugaccaaaagcaaccugggcaggaaaggucuuauuucaucuuacaugcccagcuaccaguccaucacugagggaagucaaagccgguuauugaagaaacuauggcagaucauuacauacugaccucuggcuggcuacccuggcuugcucaguccaggccuaccugccuagggaugacacugcccacgaugggcugaguccuccuacaucaaucagcaaucaagaaaagaccucccaggcaugucccacacagucuaguggagguaggcaauucccaaacgaggauccuccucccagguaagucuagcuugggucaaggugacaaaaaccaaccagcacaaauggauuagucaagucuggaagaacgaaugcugccuccaugccucuucagaacaaaauguguaacaagaaaagucaaguuuaacugcguauaccaugugagcccuacauaagagaucaggcaaaaauuuaaaagcaacccagagaaggauacugguuucugggucacuaagggaaaaagguaacaacaaagccaaacucuuuaauuaaaccagcaacaauuuugaagggagccuuuuuaaaaaggggcggggggggggggaaccaccuucuaauuacaauugauacccuuuuccaucaaaacauaaucugggcugggaagaugacucagcaagcgaaguacuuaacagugcaagcauggggaccugaguucaaauccccaggacccacauauagagccauguguagagucacacaugucuuuaaugcauuccuugggaugaacccagguaugcaaauguuucccucuccauagagguccuaagguggcaucuacucucggcacccaucacgggacauuacagagagccaaugaaaacguccagcaggcacagccacaggacuauccucaggguuaccugaaacaagccaggugugcauccaaaagguguuaucuacagccucuaccaucaagucacugauaauauaugaacccagcaaggccaggaaaagauagagguuacccaucgccagcaaaaugccguggcauaauugcuuuaauaagacagaaccaacuguuuggacaggagcaccgaacaaggagcacucuggcaggucugaccaggaaugaaagagaaaaucaugaagaaaaugcuacaugggggcuuggggauuuagcucagugguaagcuggguucagcccucaccuccaccucaaggguggggaggagacccucauacaaccgaguguuuuuaauuaucuguugacauuuauuuucaauuccaaaaacuaaucagaaaguaaaucagaagccaacugcacaccaauacccagagacaaauuuuaagaaacugacaaaacugggcaguuuuuagagcauuagcuucuaagcuuuuaacaaagggcagcuuauugccacacuauacaagccaugacaaagaagcuaaaaaggaaagccacuaauucaucuuacaaagcuggccuaaaccagacagcaaaaucuggaaaagaacgcacacaaagagaaacauaaagcuacauccuucuucaaacuguagauaaaaaggaaaaacugaauucugucauuuaacagacugacuaaauuuaauuagaauuuuuuuuaaacagucaccccacuaccagcccaagucauuucucaaagaaaucugaaacgggauuaccgcuaggugaucuauuccuguaucgcgcccacacuguaacaacaucugaauccgaagggaugcccaaaugacacgggaggacauucacagccaucccuaaucaaucacccacaaaaacuagacaaauaauuccucaacaugauggaaaccuucccaaaccaaaggauaucacacguaaggagaacuacgacaggcauggccaucaauauaagaaagaggcagacaaauauagcaugaucagcauuuagcacccuuuaggguggagaagacaaagugaaaagcccuugcagggcccacccaccuccacccccacccccaccuccauccccaccaccaccuccacccccacccccauccccaccaccaccuccaccuccacccccauccccauccccaccaccacccccacccccacccccacccccacccccacccccaccuccaccuccacagcaggcuugaaagccacacucacuugugguagccaggugaguuaggacucacuaacaagcgagaggaccagcucguggaccagaugcugccgcugacaacugacccugccuuuuucuccuucauuuuuaacuccccucuauucuuccugccugaaauacaguggugguaccuggagauaugggggccaucuugugaccgugagggugaaagacggaugcuaaugauaaagauacagaagccaggggucugguccuucauguccucuuagaaaaccaugcugccaaggccacacacugcuucccuucagacuuccuuuaccucgccgaauuaagacuuuauuaggcagguguuuagcuuaucuaucccugugguggccuccauaggcucuuguauuugaaugcuugaucccaguggguagagcuguuuggggaaggauugggagguguggucuuguugauggaaguaugucacugggggugagcucugagguuucaaaagcccaugcauuuccaccacucaugcuugugugucccuccucucuccuuacuuccuucccuccuucccuccuucccucccucccucccccauuuguggaaaagauuuaaguucuccagcaccaugcuagccugccugcucccaugcucccagcaggagaccauggacuuaaccucugaaacguaaguccccacugagucauuucuuucuaaguuaccuuggucauggucucauaacgucaacagaacaaguaacuaaaacauuuccuaaaugucaugacaccuuaaacagacaaggggguauuggauacuaggaaaacgaaggcaagcauuuuuguugaucaucaaugauucugugcacaggagaaaucggggaacucgggugggaaagcaccacuacgggaacaaucaauggauuagguagcugcaaaauaaaucaacaaaauaccguaaccuucucagccaauacacaggagucaucagagaaaugaaacaaggaggaauccagaaaauccuucuacaugaacaaggaggaauccagaaaauccuucuacaugagcaguaaggugcuaaaacguccagaaauaaucagaagugaaaaggacaaucauccaugacuugauaaauaaaagcugacuggaaagcaauaacaugccuuaaauaaguagcucaagcauuggggaaccuuauuuuuccaaaaccugacuuacaucaaucugaccaucacaaucaaaauccagugcuucuucguuugggaagagggguuuuguuuguucgguuuucccauuucuuggggcacugugagaaaagacuuguaaaaacaaaaauaaacacauguguacacucaugcucuaaguuagcaggaaugaugcuccgcaggcuguaauaugcacucugagacuauagggcugugucucugagagcagcaggucaguggugaaaaccugcccauguagcauggcagauagcucgagagaggaucgaacugucaggagcccaugucccacgucaccaaaaugcccaaugaauuuuacagguauuaaagacugaaaggagaaauucgacaaaugagaaguccuacacuugauuaaauugaauugacucugacaugaaugugaacuuuuacacaaaaggaccaagcauuaaacauguccugaauuaagagugaagaggcugugcuagcuucgaaugaaguacugucagucaacaaaugucuuagacuuggugugugugugugugugugugugugugugugugugagagagagagagagagagagagagagagagagagcacagcagauauguagaagagaucacgugauacauuaagucuuaaaagucauagacacaucuauggaacuguuaccucaagcaaaacaugggaauugauggaugaagauccuacuagcaauuuuuaaaaauuagaauacggagauuguaacguuuuaacgcuaaaacuacagucagggcucuuuuuagcauucgguacagauggcaggcacugccucugaagcaggaagcuggagcuuccuggaaaucacugcuacgauauuuaucaaagauggaucacucgcucgcucguucacucacugacucgcucgcucacucacccacccacccauccaagcaagcucuccccaaauaugaccauccccucauaagaaguuacaaauuuuacccaaagaauuaaaacaacaauaguacauagcuucuuaauaacaguuuuaaugcagagaguguuaaaugcuugaauucuguagcuauggaauaauucuacgugccagacuaauuuuaauaauuuccuuaaacaccauauaccagauauaagcagcauaaauaauguaauggacaaauauucaaugugcuaauaggaaaauuauaauaaauaaccugguauauaugauacaucuuaauauguaaguaaauauguacaaguugaaggaccagagcccuuuaagaaaauacgacagaaaacaacugguuaagauaccucuuggcugauuaaagauaauuccuuuucuuuccuaacuguauuuuucucauuuuucccuuaauaaccauucacugcuauuauaauuugaggggggaacauuaaacauaauaaaauaauuguaguggaagguggcagacaaauuugucccuaauuuaaaaguucacuguucaucaugucugcacauuaucuuuaaccaggucacaugugaaacuccugagguguuaugugcaggcacaauugugcaaagaaaaguccgaguucugagcacuggccucuccuggguacauagaacaccuuuacccacugaaucaucucgacaguccuuccacaguucaaaaguuuuaaguucaagccacugcagccacugcagguuuacccaucuggcauuucucaauauggucugauaauaaagucugcuuccacaugaaaaucacacccccuuuacaaaaaaaaaaaaaauugcuugaaauccacccucggaagaccuaagacuugaucagucacuugccaggagggacaagcuuugaugugcgugucugugacccaaguauacucagaauagucaugucuuagcuuacauuuacacaacuucuaucaugugucagaaacgacugucccauacugcccccaacaaacacacacacacacacacacacacacacacacacacacgcacacgcacacacacacacacacacacacacacgcauaaugaacaugucuugcuuugggggaggcuaacaguucaauucuuuuacauaugguaucacauccauuugcauucguggauuacguggauguauauaccccggcaggcacaccuuguaggcguugcuuuuccauagguggguccucgggauugaacugagguuugguggcgaacaccuuuacccacugaaucaucucgacaguccuuccacaguucaaaaguuuuaaguucaagccacugcagccacugcagguuuacccaucugacguuucucaauauggucugauaauaaagucugcuuccacaugaaaaucacacccccuuuacaaaaaaaaaaaaaaaauugcuugaaaucuacccucggaagaccuaagacuuggucagucacacuuugaacacagaccuuccagcuuuggaagacaacaccagaugcuauccaaggaaccaccagagucgcucugcccaccuaacaccuuggauuaaaagucucugcuacuuuccccagacgguuuguacaagaacggugagcaccguggaaaguucagccagugagggguaaaagaacugacuagauuuccagagaagaaaaagggaaaugaaaagaugccagcuucaaacacacacacaaacaagggcugcuuguggagcauucaccugccagcccuccgccaucacgcaugcagccuucacagguuccugacaccugugauuuagagcccuccgauccuaagagcucugugccacaggcugaaauuggaaagauuuuguuagccaaaagugcagcugggacugggcguguuaaagaauauggacccagcaucaagaaucuaaugaccauacgguuuaacaguuaucauaguccugcuugaauagaauugauagaaagucaccacccaggggucuuuuaucauuuuuuuuccauuuccuauuguggggacaauccccagaaggcagcaguagagaccugucauucccaccagccgaugagaaaaaacaaaacacacuaaggacaaugaucucccacuuauuuacuucaguacaaccucggacuugccacugaguacugaaacaagaucccuccagaacauggcugucuggccaguggguuaauuaaccacguauuauaaugacacgcacaguauagucaauauagcagcaguacugcaauuagccaugguauuuaaugacacagcaucucacacauauuuacaaacguguaugcagagcaguuuaucaauuaaucauauaacgauacauacaacacaaccgaugcaccguaucaauuaaucauacacuauaaaaacagguguguucuaggaggaccccacaguaaccucagggaaggaugcuaaaggcucuucacaacaagcuaacaaccaagucuccaaaaccaauuuacucugcuauggaguagacaccgggcacuaggaaaccacccagaaauacugucucugaccaagcauacaagauacacugcuucaacugcuuaggcuccuguauggggguaggggguguccacucaccacagacaaaaugauucauaggcacgcacuuggaggagcaauacaucacccguaaaacuccaucuuucucaaauuagcacacaggagcccagaaucuucaaacuagguaaauaaacucuacagcaaggacacaucugaacucucagguccacugcagggggggggggguaauauccaucaagucugcuauucagauacuggcuggauuucuuuggauccuucuuccuuauuguaccauaaguauucccaaucccuccauggugucacaaaaggucauuugugucuaaauauaccuuuuaaaaauuaacacugaaacauuacggaggaagcgacuggugcuuaguuugccccaacugugcagauggcugcuacuuguaucacauucacaagcuccaaaagccaaaacagacccuaaacugcagccucugcacucugcugauuaagccgcgguucuuuuaacuuaucaccuccuuacagucuauccaagcagaaagaguccaagaaucccuuugaaaaagccccaacgagagccugaacuggccaagcuauuugucagagcgcagugacaacaacaggaaguagaauuucuggagagagauuuuucuauuuauuuuucugucaauggcugcuuuuaaacuggaagggggaagccugcaggcauuacaaacccuggaggcuaugaagcaggaagugagaaacugcagagccucaaauggccagccagaaaacccuggcucuuuucuguagucaggucuccaaagccaggaauuuaaaaaaucuuaggcauccuacguuaguuuuucaaaucuuaaaacgaguggagacucgagggaacccgggccagaaaaaaaaugaggcggccaggaagccccagucucucucuagugccacaaaugucacccccauaauuaaacgcucaacuggaacuugcccucuacaaacaggguuuuguuuccugaucuguuaagaggggcugagagcuuucuacacacacagucugcugccucgcacuucagcuuugucacgccuccccaaaguugaaccuggaaugcaaugaggacgcuaggcacuuuacaucuccaaauguccccuacucugccuguaaacaacuuucauuuguucccagggagacacuacuccuggccaaauacagcaaaaggcuuugcaaaggccugagagagacaacaugggggaaugcucacaccugggccagggcucuuagaccagcccaccugcccgacucacuuuaccaaaagacuauaccaguauccaggagagacacucaugaacuccacccaggagcagacacuacugugguuaggucugcuaugcuguaggggaacagagcaccuuccugaugugacaaaaacuccagcaggaaccuucaucaucccuggguaggauguggaggagucaggaguccucuagcacugggaagguacuguaauuuauagcacaaucccaauugcuuuccuuacggaucaaacacacaacuagaugagcaggcaauguuagaggacaagcuuuaaaaaagugaaugcugaccuaggagggaagcagaaagaguuauguaaagucacugaauggcccuuugccuggcauccugagucaaccugucccccaagcagcgcacucaagcccaagagcaaugaagagcagccuuugcaaggcccacugaaguaagccauagagguccuccagcuucucggagacagucuucuccuauuuucucuauaauccacccuacccucaaaaagcuuaaaguccuagucaaacaacaggagccaugaguguuucuuuaaaaagacacaaagaauuccuuugcucuaaagaaacaaugggcucuccauagccuggccucauuccucaauauacuucuaccuuguucugagccccaucacacaucaagucccgaccucaagccuagucaggccugauccuccauggggacaucagaauuugggugacacaaugaucucuuccuugguuuccacugucagcaacaccaagugugucuguucagauuccuaacugguuaauacgagaccucuucgaggcaagcaaguagcaaggcguggcuguaucuuacacgguguauauccuuccacaggcuccugaacgcugauccaccccucuccaaucccuaccaaauggaauuuagcucugcccaagcauuucaaggggccugugagcugcccccuacucuuugaaaaagcaacaucaaucggcucaauucuacugcccacugacagugaauccagcgauaucuaggcucuuccacagguaccacagacaaaucagaacaucccucugggcccuuggggacuuuucuccucaggacuccaaagcuggcacacauuaauggugacaugguaauaaaucugcccaggggacuucaguguggagggugugagcugguggcccuguauucccaggauauagaaagaagaauccaaucacuauggucuuuccucaccacuuccagcuuagcucugacacucaauacuucaccguacagcuucaaggaauucacagcaaccagcacagcugcccucaggcaacucuaaccaaccuucaacaucccaggacuucacacagucccugacucuccacaaacgugcauggcuccugagaacaccagcagguaaucuggauggagucugagaaauucucucaggggcuugucuccccuuccucuaauggagcauggcuucuaagaagcgugggccccuuggaggauucagagcugcagacagcccauguucuccugaccugaauacagagacucugggguuggggguuggguguggggugugggggucccaggugaagggguccuucagacuguuucaucucucuagacggcucccaggauuagcagaguagcuugaucgauacugguuuuaccaucacgggagugacucaccacaaaaaccuacccaucuuaaggcucagcugugaacagaaacaaacaacauaauagcagggucagauucaaaauagcaaguaugacugguaaacaguuaaugcuuauaaacaauuagcagcagccuccccagccuucuggaugugcugaggagaaagacucaugguuucaccggcucugaaggagcagcugugggggccuggcgcggcugcaaccugugcagcccaccggugcugcugucggcuccacagaacggaacccugggggagguuccagaugagccacuucugaccugauuccagagguccgauaagaccacagucaccaagacagggaguuauguggaacuggguuuucaaguuacaauuccuccagaguauaauguccucagguagcuccugcagagcucaaaauaagcaguuuuaucuuuccuaaagugggagauggaggcacguguaagcgggggccucucagagggcauccgguuuaaaaaaagcaaugggcuauacacacugcuguucuccaaacacauacaguggucucucagcauuggugggggacugauuccaagaucccuacacacacacacacacaaaaagcccacaaugucagggagagucuuaagacaaaaagcaucugcgugccucacuucccccaucugucaaucaccccuagaagaugggcaguaccagguacaacacacgucauaauguuuuccucagagaauaauaaugaguaacaaguuuccaguuucaauacagcaugcgucuucuuucuccccacccccaaauauuccuaaccugugccuggccgaauucaugaaugcgagcccauggauaugaagggcugaaauguacaauuagguguccaguuucacuugucucacaguuaaucugcaauccacucucagauuuggccaagaaaguaaaauaaauaaauaaauaaauaaauaaauaaauaaauagcacuagcaugacacugagaauccggaacuacagauauuccuaaccugugccuggccgaauucaugaaugcgagcccauggauaugaagggcugaaauguacaauuagguguccaguuucacuugucucacaguuaaucugcaauccacucucagauuuggccaagaaaguaaaauaaauaaauaaauaaauaaauaaauaaauaaauagcacgacacugagaauccggaacuacagauauuccuaaccugugccuggccgaauucaugaaugcgagcccauggauaugaagggcugaaauguacaauuaguuguccaguuucacuugucucacaguuaaucugcaauccacucucagauuuggccaaaaaaguaaaauaaauaaauaaauaaauaaauagcaggacacugagaauccggaacuacagcacaucacucuguuguuacagacuggaugacuaagugccccuaaaaugucagauggaagcuccaagucuuccaucugaagggaugguauuaaaagguaggcccucuggaacaagauuaggcuggaaagaggucaugcggaaacugucacaggaugggaucagugucuucaguugcucuccuugccacaugaaaacacagcaagcagacauuuacuauuggugagauaggaaacugaaguagcugauaucucaaugcuggacccagcgcuuaccaagaggugucugucccagccgcucagccucggucucuguaaucugugauagcaaauuagcuaacugagacauccccacugccuaccaccaagugagagaugggucucaccaccuugggcuugguaacaccucccaugggauggucaggcaaagcagacacacagagacagggguaccaguuuggaaaaggcaagaaggaucagucagguucgcuucuggcauccagggaaacacuagucugacucgcagacagagagcaauggcucuucccaugggucacaggccaagaggagcugcggugggucacugggguggaggaagcuccuuucgcugccagacaggcuugacuaccugucuggaauucggcagguccaggccugaguccugugccuuguuaaacuagauugagacaaccacauccaaagggcuggccccaaagaguacauucuggggagguguugaggcaacgcuggccuaagccccacagcacguguccuaugaccucaagcagcagcggacuugaaagugcuccgaguucuucaccuaugaggaaaaaccucuggccaguuucaacuuccagacccuugaauucucgacuacugcauccaaucucuuccuuccaucucucuaugugauggggcaguccauuugccauuaaaaaaaauuuaaaaguugagcuguuagagcaaauaaaaaacuuccaguacaaucagggagggaaccaaacaucuaaacaagacucucuucuggaaaaaugagaaaauaauaaauuaaaaaaaaaaaaaaacaauuagcaauaagcuuccccugggauggcaacaacacuagccggcacuagcguuugacucuggacuugauuuccuugggagaaaagguguccagcugcagaaggcagacucagccccaugacacccagcucccccaggugucccugcacuuccacugaggccugggacacuggccuggaaugucucgcccauagcucacaugguaugaugucacuaugcaaugugauggacagcuuuuuuuuucuucuuaaaaacauagugaaauacacacaacucaaguuucacuucgcauaccacguucaacauucauccucccuacagcucggaacagacccaccgccuaagucugaccagcauuccauuguacguacgucacguucuguguacucaaucagcuuccacggguccuuggucugcuuucaccuuggcuuuuaaaccucacucgucauuaacuguguacaaauauggguaaaugcuaguuuacacgauggggcaucuacuccgaaguggaauggcuauaucaugguaacuccgcauuuaccuuuggaggagccuacaccacauucagguguccaccauuuacauugccgaggcucucggcuccaaucuuuccacgugcuacucuuguuaccgacugguuuucugacaacuucauaggaagagguaugaaguagcaucaaccgcggcucugacuucaguucaucagugacuuaguggggcugacugagcucaaggaauuagcucuaaaccaaaggaaucccuccaacuccuaagagauguuugguuagaaaagcaaacuaucauuacuauugacuaugauuugugaagguggcugaauagcccaagcucaaaagauacuucuaccuccuaccaagcacaaccaggcauggguaggcuugaaugcagguccugaggaaguggggaaggggguguggaaucuagaagcguaauaagaggcaggcuccugcucuguacucaaggaaggcugaccuacaagaacucauuuaccagguucuaugugucagggucccacuggagcuuucuuguucuccacauacugccggggucaucucugggaacuccuccuaucccuaugggaagcccuugaucuacaaggaccaaaggauuucaacuugucccacccuuaacuucagcuaaucuuaccagucaucuagaaacauagaucuuggcacuucaaaucgugaauccaaaaucuggcugggaacuuaaacccccacccuauucccauacuccugacuuggcuuuuuaaacaaacaaaaaauccaaaaaaacaagccucacuucauagcucaggccagccucaaaugagcagaaauacuugugccucugcuuccugagugcuggguuaaaggcgugcgcagacacacaccgugggacacacuuggccccucgaucugguuccuacccagaagcuacgugaccuccaauuacuaccccauccuugaaaagggccaagagcaaagggacacaaggcucugcccacaucauaaugcaccaaccacucauuucuguccuucggccacuugaguggggcacaggagccuccuuuaaaggguaucagaacccagaucugucuucuggaagaagaugcuucaacccuugccccuaaaggcaggaacacgacgagaagacagaaaaggcagagaagacaagcaggaaggacagacagauggacagacgaggaacguuucuguccacuggcagggugugaaaccuucauggucaacaccaacagguguagcuaagaggcaagcauccgaucagcacacagccaggagaguguucuuccccacccccuccuccuccuccaaacuaucuuccacugcguauccccucugcugggaagaacagcagcauccaccaucuggaacccagggagggcagaguucaauggcuuuguccagcaucacuaagaaaguacuugcgagacuuccuuccguuuccuagaugaggaaagaggggagccgggggagcaggacacagcugaggcucaagauugaacagagcucgccaaacaagucuggggaaugaagcaagcaggcugaaacagucugcagccuacuuugcugaauuugggggugggggggaugugugugggggaaacugagucacuuaaugccguaaauuucagaaugcacuaaaacucccacagaccaaaugaugccaccuuccuagggcaccucaugugugaccacauuuuuagacuuguugugaguggaaaugaaaugaauggcuccaguugcaggccggccagcugggagcucugucccucugucccuuggcuaaagccccucaacuguucucaucaagaauccccgugugcccgacccauuuaaagucacaaaggagugaauguuaaaaugcacuagucgcagcccaggcugggacaccacauuggcaagggcuggaaaucauccuaccaugcuggcuggcacuacguggguagaaggagcugcuugcuugucucaaccacugggagccaagaucaaugcaguggcagagggcagggccagccucaggcccacccgacacagccuacaaguaagcaagaaucuccuuuggccuggguggcucugaaacucagaaagaggcacccagcaaauaacugugggagugucuucuuggaaagcuggaacguuuauuuuuggaggaaagaagcaucuugaccgcaaacaccacgcacgaccccuuuucccgaagccaguuuuaauccccagguaaguucugcagucuccggaaggaaggcuaacucaagaccccacuagaagcagguuccucacccugggcuuccucaagggccugcuuuaugcugcugaccucagacuugcagcugcuaacacagagccaugggccacauucuacaggguccccuccucugggcccagggucacaucucacuaaccccuccagcacaucacucacccccacugccaugccucagagccaagucacuaugcagugugccccugcuccucagauccugggucuagcgauggccuggcccucccuggcucucugcucagugccucccugugacaccauccccagucuccagugcuggucccacagcggccucuugaaagcucuuacuccucugaucacaggcuccaaaagcuuuacgguuucccauuacccaagcaucagucaacucccuccagugcccuugguucucacgcccaccuuccacuccaucugagcaggcuacugccugccaccccacgcccccacccccaggaugcugucuucaccacucugaacuaaauacugguggcacacuaaggcucccucagcucuucagcagcacaaagacuggaccuccaaaggugugugugugugugugugugugugugcgcgcgcgcgugcgcgcgugugcguguguguggggggguguugguguguguggguguuugggguuuuuguuuuugaucucagaucccauaauuuggugcugaacauaaacuuccuauuacuauuugacaguaugugaaaugacaggaccagaagugcuuccgagacagggauguuuggaucuggggauaucugcguagacgcugccaaguagcccuaaucugaaaauccaaaaugcucuaaaaucagggaaacuuccuuggcacugaggcaauggaugcaaguucuggauucuguagcauuucaaauuucaagcuaaagcuguuccacuguucuugauuuuuuuuuuucccaagaggacaacaggacaacaaauuuugggggcagugggggguggggggaaaggccacuaagucucuguacagaaacagggcuuuguauccaacccuuccccaacuucaaagcucuuacuuccaugucucaggugaggauauggccuugaacugugcuuccaaaaaccucauacuuccucaagcuuuuaauuauuauucuacuuguaccggugcuugucugcacagucguccgcagaagccagaaggcagcaccggaccucuguagcuaguuacaggugguuguuaagucaucaugugggugcugagaagugaaccuggguucuaauuccagugcucuuaacugcuaagccaucucuccaaccucggcuucucagguuuaagccaaaauaacugauauaacaauguuucccuccuccaccauuuucccaggggcugcuaggaggacuaaaagacaggaauccccgggggccucacagccacgugggaggacaaaaauccacacauucguuugcuagaugccuucuacugccuguuucuggcgggcaucuuaaaaacauuacugcuaauucccuuuggcaugccugcuagaguggcacuuuuucaauuuacagguggguaccaaccaagguccgugcuucccgcucuagcaugccaccaaguaccuggggagagccggcuucccuaaaggcaggguaggcaggugagcucacguccacucagcucagccgugaggcgggugaguuuucaaaaaugcuuuuucuauaggccacacuugaaauaaaacauacugcguucaaugauucuguugacauuuuucuacaggaaacagaccaccucaggagcaucaagcuuuuagcaaugaccuguggguuuuaaguucagcaguccccuuacagcauccuaggcuaaguaaacucaauucuguagaggugagguuuaccgauaccccuaucauaaacucuugacaguccgugucaggaacucaaaggacaagcaucuaagaccuggcuacugcgccugccgggaugcgaggcaacuuuuuugcuggucucauccaaacgacccucccaaggaaaccacccucacugccugguuuuggaauccaaaggcugaacaagcauaacaacucuuccagggacccagggucauuccugaaggagaaggaacacaauccucaggauccaccgcagagggacaggcagccacugccaaccugaagacagcaaccuuuuaugaggcagcuggcugcccaaugguucagcguacacuacacacaaaggaacugauaauggcaaaucagucuugucuucucaucagaaugaagcuuaaggggcguggucacccaccucagggauacaagacuagaucugcagauggcuuuucuaaaguguuggguauuuugcuuuguuuuuugcccaguucuuggaacaaaagaccugaacaucauucuacugcuucuaagugcuauguaguaacuggugugauaaaaaugucuccaagggggcuggugagauggcucaguggguaagagcacccgacugcucuuccgaagguccgaaguucaaaucccagcaaccacaugguggcucacaaccauccguaacgagaucugacacccucuucuggagugucugaggacagcuacaguguacuuacauauaauaaauaaauaaauaaaucuuuaaaaaaaaaagucuccaagggcuaagcuacuauggcaaggacgauauaagaccuucgcugucaaugaacgguacaugcauccaagugaaugaccuacagguggucccuuuaagaagucugccauuuccugagcaucucuuacccaccaaacaucuggcuacuuccugguguucaaagguaguagagaaacuguccccuccccuaugauggggaagaacagguucagugcaucacguguaaaaagucagaaacguacaaucaacuguugucuggccuuaaggggggcaaacuuguaaauuauuuaauuauucuuucacaucuuagcgaagcaaaccuuguauuacagaacgcacauuuauugaacacuuaguauauaugcugugcucugaaccaaucuagggcagugaaaaucuaguguguucaacaucuggcuucagucagggccugccugagaaacagcagguggagcugccugaaaugucugggcagaaaacacacugaaguccucucucagcccagcaaaugagcuaucucccaguuaaaauuaaaaaacaaagagccaccagggaagaacgugaccacuagauacagugucacuggggaaaugggagaguagauugagaaauuaucaauaaguucugaggacaaaaccaaaaaagucugacacagugccuccaacacagggaguaauggagcugccugugauggucugucaucaggacuguuggguagacauuuuaacuacaugaagcagcccaaggggacgcacuucagagcgaaauuugaagugucacucuauguuuaagcagagaggucaaagacagaccuugcucuaugaauaugccauucgaaauuaauuggcagccuucucaaaacguuuuaauuacguuuaucugggaggggucgugcaagugucacgacacacauauggaggccacaggacaacgugcaggagucaguucuauucuccuacugugcugagucccaggaacugaacucagaggcagacuuggcagcaagcuccuucacuggccgagccaucuuguugguccuagcaguauuguuuauuaaucucucauaagaaauauuuuaaaacugcacacacguaaaggucucauggccuggggguaggguacucuuaggacuguaagacccucuggguuuuacaggaaggguaccucacuucggaauacaguugcuucucugagccgcucucugaacaguuaaacaagcuguauccuaaaccacagcccggcgaucucuaaagaagccugguguacccacauuuucuugcaaccauuucucagucaccaucagcagggaaaggcugaggaacuuuaaggggauuggcuuucuuccuccucuggacaacaccuacuucagccagggagauggcugaacucccuauguggccgcuagauggcgacuucgcaucggugaggcggacaaagugcagauaggacccguucuaagacccuggcagaaacuaacgagagaaaggauugaggaagaaacuaugacaaacaacuguaaaauggaaggugaacagaguggagcuggcuacccuuuggggggggggggauggcgggaggggauaaaauaacggaacucagaaaggguuaacguuuuuguuuuuguuuuggugguuuuuuguuuuuguuuuugagacaaggucucacuauguagcacuggcuggcccagaacucacuacauauguagacuaggcuggucuuaaacucaaugagauucaccugucucugccucugccuuccacaugcugggauuacaggccuguaccuuugauuucccguauuuauuuguuggggguggggaggcaugccacagaguacccguggggggggggggagucuaccuuggagaguugguucucccucccaccaugagucccagggauuaaacacuggucucuuaggcuugauggcaaucgcccuucaccccauuucacagaggaggaaacaaaggcacaaaauuaaucugacugugcuacugaagaacuggcauucaaaccagccucccucgccacuccucaucccgguaagucaugacagggaaaggacaaagcccgagggagacuucucagugugcggccugguggugccugaacucaaagggagggaggggaaaguuagagcugugcaguuagagaaacgcuaacagccucaugugaaggagaaggcggcggguaggacaucaagggcggcaucucucacauauuaaaacccuagaaagugcugggggggccugggaggaguugaccggaagccuacccuaucggcccaacuuuacaguaccaacauccaaaacuggacaccccccacacacacucaaaaaguaaugaaacuuaaaaauccacauuuccgccaaauuuuccugaguuuaauuuuucuaaauauaguagaagauaauuuuauuuugccguuuacagagacaaggagaaccgucuuucacagucaucccgagucuccgccuauuugcucaaacucagagaaguggcauguuuuauaucagagaacugauggacggcccagaggaaucuaggcccacgugaccuuccauuguuccagaggggcuuuccaauguccauugcggggaggggggcagaagacugugguggaauucaugccaagucacagaaagagggcaaaagcuggagugggggaucaucagagcccacucaugcagaacucuggggaucaauguggauccugacagcgaggucuuuaugaggaucuacuacagcccaauacgaggggccuuggacuucacauuaagacuggggacucgccugcgguacacagcgaggaagcaggcuugguaagcaagcccagggaucuuuauggcacuuagaaguaucucaaaggccaguaaguaugcccugucuacucaaaggguugggaugcaggucuggacuggauggggguggagccaggauggggcaaaucugcaugauuucaagugacucagugaaguugagaggaaacauucaauuaagcacucucuucagaaaagggcaggaagcagagcugagguuaacuagaccuuccaucgcagccaaucuuggugacugaaaagcucacuggugagcgugcuagaagaaauggggagaauacagcauccaaccaagaaaggccgcucuuagcaacggaagucucuaggauccagcucuucuacauuguggcucaacagacaucacgaagccaguaacgccccaaaguggacaccagaaccaucggcggggcgucccugugcguucccucaguacagugaugcccagggagaacugucggagagaaugaacaccguaagacacagcuaggcaugaugaacuggugaagaauucacugacugucuaaacagaguggacggcuagugacucagaauggucuugucaaauguccagucaaccggacagacggcuguuaccugaaaucugcacaggugcuacuuauuucuuucagcuacuuaucaaagguuacuaaaauaauucaaauugggagaaaaauaccuguacacuaacucacugcuaucuaauaucaucaggcuucugugccuuacgguacgugucucauuuacucgaucugacacacucccccaauaaucaacuuauagauaagcaaaauaccucaggaacuuucaaguucugaucuguaaaacaauuuaggcuucaauaccauaaaacauguguuacccacauaaagauuaaucuuaaaaacgacaacuccaaagccagcuuaaaggaagugccguguuuaaaaagaaacuggcaaguuuaaguacacagaagcccaggagcuaugcaccucagucggucacucagucucuguggguggaggagugcacgcaugcacaccuggacaaacaugcccaucuggaugcacaugugccacugugaggagcuggcauuuauguaacuccugcagggaggugugaaguaaaaagauagaguuugaagccuucagcuccuacuaccaggaggaauuuucuguaauaaugauaaacuccuuucuacaaacgcuucaagaggugccuagccaacuucggugguacaggccuaugggugaucccuguacucugaggcaaggguagaucaaguccaaggccagugugggcuacaccacaagaccaucucuaggaaaaaaacaaaaaucaagaaagcaaccucggggucucuccaaaguuguuucugacauuccacugcaaaguaaacaauuugggacagacauucuucucucugcaauacacacuuccaacauggccacauucuucuucuuuagcaggccaccagauacuccaugagaaauugugucaagccuaccagaaaauacaggagggauacucccuaagccucaagacgcaucccauaccagcaguaaccaacuugaggauaaauauaaaaccaaacagcagcgucguuaucuguggaagucaccacagucccacuguucaucacucaacauaaaggacgccaguuuuuguucuguucgaguaaugccugaauagcaaucugugaguuuauaaauccuuacaauuugcgacccaaaagaaagaaaaauuaaagccuugcucacuagcuucuuaguucuuuaugcaaacauagccgugauuucuguggcucaauucauacucugaaaaacuggugguaagacucauuaugguaucagcguuucuaacccagagaauggagccuugugaguacccaggguauuuauggaagaaaguggaugaauucucacucaaguagggacauagcaaccuuagggcucuaaaccccaucacaguaauaaagaguaaggaaaacuggcacgcgugagaacacauggcauccaucuccagaaauccaaagucaccaaaucaaggaggcuaguacuuucaguuaaaggauuccaaacaauuuaagaaaagaaacggacuucaucaugcuaaggaacuacaucugcugagauagcgaacuaacucguuuuaaagauccuuuguuuacuguuuucacaagcccauguccucuucucugaacaagucagacccagggggugaggggaucgagacaaggcaccuguacacauucuaaucuuuaaucuuuaccaauccuggacaucagccacgcacuccccaauguccacagaucucagcgucaccgaacacuaggacugcgcccgucccaaauaacacgucuuuauaaggaacuuggaaacuuccucuugcagaccugcugccaaacacuacuuacaggaagcuccgagugcaucaucacaccguacagccuguuugcugucuuucacgugcaucgggcgucucagacggagaagccaagagccgccguggccacagcacguguggaaguauuacauacuuaguacuacugaaaggcguucauuucuggugcucagauagcaccugucacacgcuggcuaagaaaagcaguucaaagcaagcuggccuccgggcacaaauaccucuuccacgaacuagaguuugaguuuuaaaugagucuugaaaacaaaucggagaaaaucacaaaccagagaaaaaccugucuugugugcuuuaugauucaaaaaaaaaaaaaaaaauucuuuuaaagguacaauugccucucugucucguucuuacacccccucccccauacuuaaaaaaaaaaaaguccauucguuuuuaaauuacaaaagauuuggaauucugaacacuuccuaaugauuaucuccaaacugugaaagcaauguauacaugggaaacaccucugcaacuggucccaccuuccaagccaggcaacacuuaugaauaucccuggggggggggggguugauuuuggagacaaggugucacuacuuagcacaggcugcccucaaacuggcguuucccccugccuaggcuuacaggucuaugagugcauccagcaugacguuacacaggcagcguuaaccacgacugucacaccaguguuacaaagacgcccaacuagauggacagguauccgugggccauggucuguggugaaauuccaauaugagggagccugagaggguaagaacaguguagcacuggcuacacaccagaccagcuaagccuacaguagauuguuaguuuuuguaaagggccucuccugcaaauacagggagaguggaaccaaaggcaacagcaaggggaguccguccuuccucuccuggugaucgcgccaccuagcauucacuucagcuuucacacaguaagggcccacuaacugcuggcuagacucagucacuugaagugcauucugacaaaccaaaugaaaccacauuaaaaggaaaacuaaagugcucucagggcucccgggggggggggggggaggaaggaaggacagacagacauacagaugaacagggagacagacggacaaggagugaagaugaucucacugauguucauuacugaucuauaccuugcaaccauaacaagagaucaccaacagaugaccuggagacagagaccaaaaacccaaugcaaacauucccgucuaggucuguuccuacggaaaaggcaaaguacauuuagauaaaggcacgccaguuugaaaacaaaaccacuugacugugugccuaaaauuaauuuuauuuauuuauuuuuauuaaaaacaaaacaaaacuguuaaggcuacagguuccuaaacaacaacuguaaccaaccaagaugcaccuucucagauucuggagauuuuaagaaauaaaacuuguaaauuaaagaaaaaagaaaaagaaaaagaaaaggaaagucgcacgcgcacugcccuacaguaagcgguccuuccucugcaucaggaccacuuguggcuacuacaggagggaagaaguuccuuccguguggcuaacaucauacuacuucucuacuggaaagcuguagauagaaacacgccccuugccuuaggcuccugagcccugcagaaguucacuucagguucuguuugagggcuuucacuauggagcucacaccuucauuagcacuggugugcugucccgguugacuccauccaucccuccauuuaccaagccaaggaagagcaagauuccuuucccucuacuugucuguuucuugccuggcauccaauccccgcuguuacagcuucaauuaccaaucugcuguacugcaggaauucauggaucuuaaaagcucaugaauuugggggugggggggagagaccaacucaaaccugcaccuauguuuacugaauaaucuuagucagauuuuaaggcuuaagguagcacaaugcauucuucucaaucuuugaaaaaaaauuaaaaaaaaaaaacaaaacagguucagauguuacucacauaccccccccccaggucacuguuuucaaccauacaauucaauuuuuuuuuuuaguacauugagaauuuguacaaccaucaccacaaacugaagcuaaaacacuuucaucacacacacgcacacgcgcacucgcacgcgcacacacacacacacacacacacacacacacacacaccugccccaaauccuggaccccuuaacaaucacuucccaguuuguccuccccaauaucuggugagcaauuugucucucccuauggauuggcugaacauuucauguaaguucauguaguguucauacaagauuaggcaguuuauaacuuauuuucucuguuuuuaauauuuuaagcgcccggauguucaacccuuggaucuuucagagauggucuuuucuaauccuuuugacaauucaaacauaugaccuuuuaaacuucaagcccugaacccgcaccagucuggcccuccacaaaguauaguugacuugcuauuucccugcaucaaaaccuaaacuauaauuugcuaguuagguucuuucugaaguucuuauucugggcucuccuucugguagguaauaaagcacuaacuucuuuaaacaccaacauugcacauaccuccuuuccucugacaauaggauuuuaccgugcccucggcagaaagaugacucaauccuuuuuaggagacaaccacaauaacucucaagugcauguugauuuucaaaacagaaagcggcccuacauuaucuggcugcucccuuuccuaggucugcucauucucccgcuacaaaacaaacaugucugcagggcugccuuucuucaagaaacuuccacagucccaaguuaaagaugaaaacauauccacagaugucgcacuccaaagaaucaccauuccuuaaaccuaauaccuguauggcuggaagacugccucugcuggcacccagagacuuucuccucaguuaugugguuuagcaccuuuggggcuaaaacuuaacccuucagcuguaaagagggaagggcagacacccagacagaacuuuagcaggcccuaaccaggaucccaagugcuuucaggauggccaucaaacuuuaggaaauugaccaucauaaaaggcggcucucaggaagcguuugguccccaccggauuaaaaacaacacaaugaaagacccuucuccugcugccccugcucuggacaaagaauauccuucagcaagacccagcuccguccuguuucggaugccugcauccugccccaagaagcaaggcaaggccaccacugcuucuuugcauugcagaacuucugcuguuaaauagcaaaaguagagauguacacaguacaauaagaugccauaggaaaauggacucguuccuagugucuucuaaaccauauuuaguccuuaaaggcuagaaaucuucccugcccccaaacaccaucuaaccgccuuucacccaauccagugugcucaaaguuuggaaaacaaagggcaggagagcccagauuugugaggucggccauagucugcgagucuuucucuagucuuacuauagcuauaguucuuuuaagaacuacucggacuccaucauagauauuucuuaaaagaggcucaaggguuuguuuauagaaacagccuuugugaacuacggcagcgguagggucccuagcaggcuccaucgugucacaccccccccccaccccaacucaaggcuaggucgugauuuuucgaaguuaauaggcaccaccugcauacauucugcaaacauuacucauccgcacgcccucacuuccccagccccuacucggagacugcauuuaaacuuuuaaucgcguucaaauuacucuaccaucucuaaagcaccaguaugccacacuguuuuucucgagaacaaaacccccuccuccuccuccugcccgcauacacuguggagaguucucauucccagagacaccccccaccaccaccuacuccuacccgacaccaccaaaacaaaagcuaucagauugcaagcgauagcaagcaugagcgauacugcuuauuaaguauguacaaaggaagugcagagcgggggggggggggggggagguguuggcagugcaccacaacuuuggccacaacaaaaccaaggccagggcuccgcgcucgcaaaacaaaacaaccacccguccacuaccacacuacagaucccgucgcagcucaacccaccgcacacaucucucccccaggcugggaguccgguucuccccucgcggucguguggcuguggaugcaccuaaauccgcgcugaacacguguguguggaaaagcacgucgacucugcacaaggguggacguaccuaucuccucuuacuaagacgcucugggaaaaaaguguccagagcuggauagaaacugagagccccuaagccgaggaucauccaacccuccccccacgaagaaagucccaaguucacacuuuccuagaggaaaauggugggcacacccugcaccccaaggccacacuggacuguccaaguuaucaagccuugggguagguggguagacgcccacaggcuccagagaagcgaaaggccaagaaccugagggggucgaugggcccaacaaguugggugauaggaggcugcgcccugauguuuggaaacguguccuggggccgcgaggcuuccaaccauccuguaucucccccucaagaacaacuuacaccccgcaggguaggaggcuccgaauugccgccacggagcacuaggucuaccccagcaaccacccguggagccuccaagggugcugucauggugagcugcgcgggaugggcgcuggggugccaaguggagcgccccggaggggggggggcgagaguagcgggguucccgaggccacccagacgccaacuuccccaccaagcgccuacgcgggggcugccccugacccgccagcgagaaggcacugcccacccaccaggccgcgugcgggacagcgcuccccggacagcgaaagagaaagcccuaaggcccuucccgcgcgcagaugcgcugagcuagggcucuaggagcuccugagucgugaacucucgggcccugcucuacuccggccuuccgagagagccccacccuccacucccgagccccgaaguccgacagcugcgcccguggcaacuggguuuucccaaacagggcgcagccccucggaggaaaaguucccgcaguggccgcgggcggcgggcaaauacucacuuucuccacucgucggccagagagagagcgcggcggagagaaacacgagcccccacagcgaggucggggacccuccuccggagccagacuucauuccuuuuauuugggacgaaauucccuuuucucaaaaauagaaaaaaaaaaaaaaaagaaaagaaaaaaagaaaaaaaaagucuccaacucaguccucacucucguccaaaaacaagagcgcaggcgacgauccucggaaagcggcguggacaaggaggguggcgcggggcggccccucagcgccggcagcagcggcccacggggcggcggagucgggaagccggggcgcgccggggcgggcugucggcgucgucggccuccauuugcaaacgcagagaugcagaagaaggaggaaaacuguacagaaagaggagcaaagcccaaaucgccgcaggcgaggacaaacgccacccgauccccggagggaacgaccaccggagccuacgcggcgggagagcgcgacgcaguuggcgagacugguccgaagucccgggcgcgggcgaggccggcgaggggcagaaaugcggaguggaaaugaaugagcgguucccccuccuccggcuccuccuccuccucugggcuccgcucgccgccgccuccucccucagcgccgccgccgcgagcuccuucccaaauccaggacacacacaaagcggcggccgc

SEQ ID NO: 12393 - RNA, 27061 nt, Mus musculus
cuggugaggaaagugcugucuaucgcgcagcuuccaucccuccguccgagcagccucucggaguccaacccuucacaucugacagucgucucugucccuucuucgccucggagcugcuaacuggucucgaaccucucagcacuucagcuucuagcggcgaugcaugugaucaagcgaggugagggguccguggggauggggaggaggagaggggacccggcugcggagagcccagcggucacuaucgccggcccgcccgacccgcccgacccgcggcgccucgccgcuucccgcgcuucccgccgcgcuucccgcccugucugucagcugggccugugucugcucagucuguccccauucucuugaccuuuguguguucccuuugacuuugacuuugugcucccuuccagacucccuccaacccugucugagauuguucccgagcacuguuauuccuugccgccauccucagagguagcugcuuuuggcuccauuuuuuuagaagagguugcaaagacacgaaaaagcaccccaacacccccauuccaccccagcuaguaguuggugagguuagaauugaaacccauagcucauaauagcccugugccugucuuuccucauuucuuaaacaaaauaacagacaaaagaaccgcggagucgaugaucugguguaggaggaaauaaggaaaaaaagaaaaggcaggacaccacauuuuuugaacaucugucauuuuucuggucucuucugaggugggaguguaguaucaucucuccugccucugcauuuuuguggggagguuuuuuuuuuuuuuuuuuuuuuuacauuguuuguucuugggacaggguuucucugacuggccuggaacuuacucuguguagaucagucuagccucaaacucacagagggcugccuccucuaucauaggucgauagacaaagacuuuuaacccaaauagacaaagacuuaauccgaguagacaugauuaaccacugagcagucucugcagaccccaaagacaaucucuuaauuguuuuaaacaguuuuaaaagcugaauauacuugauucuuugguauugcccgcuuaauaacugcuaaugcuaacugugauuugauuauuuagauggccgccaagagcgaguuauguuugacaaaauuacaucacgaauccagaaacucuguuauggacucaacauggacuuuguugauccuguaaguaaauacaguguguaucagggguucuuugcaugcuaugugauuuuaugucacuuaccucuagcccuucacuuaacuauacuucaguguuaaaugugaauuuauugccugacacuuuccuuaauuuugauguguccuucaaguucucauuuccuggagaacucagaacaugaacuaagaggggacaguugaugugacuacuggucaggcaucuuguuuauccguauuuagccacacaguguagaaauuaguucuauuuaccgucaucuggaauuaggagugcuguguaucuuacucauuuaacuuuuaagagucucuaacaguuuuauacauacauauguaaaauacacuuuugucauacuuucuucagugaccucuuaucuccuuccuacagccaucuucuccauaagucucuuagugcuuugugugagugugugcauguguguuuauguguguguuugugagugugugucugggucccuaucugucccacuucauuuacuuagaguuguugugugaacauuggucuggaauuaauuuacuugauugagcaagggcagcuuaccagugauugugccacugaggguuaagacuccuccagcaaccauuauuggucugcagagaucuccucagggaaggguagggccccaugaacccugaaugcugaugggcccagucuugucgugcagacagccacugcaacuauuuucaugaggguuuuuuuuuucccccccuuuggacuuaguuuaugucucugugagugucuaccacaugugugcagguaccugaaagggccagaagaggguauucuacccaucuuguggagcuaguucaaagcagcugggaaucucccgugaugcauguuggaaaccaagucagguccuuuggaagagcaguacacacuuuuaacugcugagcuaucucucuaacccucaugaauaccucuuauucuugggcuagccucagugugucauuuuucuaacuagguacuuaauacaugcuuaguuuaccagagugaaaaaauaauuuuauaccuuaaaauauauuuauuauaauucuacacauuuuggauuuugagauaguaauuaaaauaguugaauguugauauugggauggaucuuaagaccucauccuauuucgucuuuauucuguagauaagauaggucuaaagagagagaggacacugcuuaaauuaacguuagugcaaugggaaacaaauggaguaccuugguuuuuagacauucuauugccucaucuaacagcacauguccacaugcagggaugcauuagugggcuucagcuuuccaggguggauccuguugaggacgucugggugcuaguagauguagcacauggaugcuauacuguuccaaguacuacauaacaucagaaacuaugugggcuugacugcuuucauacuuaucugcugagucaagaacaugauaucagaagcaaacuggcuuagcuauguuauaauaccagaggccccacccacacucagacuacuuuugacggagauaggcuuuggccaacuuucccuguuaagcuguuuuuaagaaaaauuuaguaaauauguagauagaacuuagaguuuguuuuucuuuagaauguauggugggcugaggagauggcucaguggggaaagugcuugcuuugugagugugagacucugaguuuggaucccaacacccauguggaaaagcccggugugcagcaguguguaauggcagcucugggcagcugaagaaagggccagguccuagguguacagcaagauggcaaguucuaagcucaggaagacacugucucaaaggacaaggcagcugccacgagcucaggggaagcaccucuuucugugcugauuccuggaccacguguguuaugugcuuguggguugcuuuuuuuuuuuuuuuuaaagauauuuccuuuauaaacauuucaaaugcuaucccgaaaguucccuauacccucccuccacccugcuccccuacccacccacuccugcuucuuggcccuggcauuccccuguacuggggcauauaaaguuugcaauaccaaggggccucuuuucccaaugauggccggcuaggccaucuucugcuacauaugcagcuagagacacgagcuccgggguacugguuaguucauauuguuguuccaccuauaggguugcagacuccuucagcuccuugggugcuuucucuagcuucuccauugggggcccuguguuccaucuuauagaugacugugagcauccacuucuguauuugccaggcacugagucaagaacgagacagcuauaacagggucccuucagcaaagucuuucuggcauaugcaauagugucuggguuugguggcugauuaugggauggauccccaggugggguagucucuggauaguccauccuuucuucuuagcuccaaacuuugucucuguaacuccuuccauggguauuuuguucccuauucuaaggaggaaugaaguauccacacguuggucuuccuucuugauuuucuuguguuuugcaaauuguaucuuggguguucuauguuucugggcuaauauccacuuaccagugagugaauguggguugcuuuuugucauuguuguguuuacuuuauguuuuuucuuuauucuuugaacauuuauccuuacuccugugaaagaaaauaauuguaaucagcuucaauuaagacauaacuuacaaaaaacgauucuaguuuuaggccagccaaggguacauagugagagagugucuggaaacaaaaccaaaaaucaacaaauaccaaagcuguguuuuaugcuuugggugcuaaugcucuuuacaucuucagugucuuuuuacugaaauaaaaauaaggagagcaguugaauccugaaaucaacucuggccuccacacgcuccugcgagguugagugugccuacaccaauguguacccacacaguguaugguagugggagaugccuccguugggagugcuugucucggaagcaugagggcauuaguuuauauccccaggacucgugggaaaagucaggugugagagugggugcuggugggaaggcagauacaggggcuccccgaaguucacugacugguuaucuugcucaaacaguauacuccaggaucagugagagacccugccucaaaaacuaaaguaggauggggguuggagagauggcucagcaguuaagagcacuggcugcucuuccaguggacuugcguuuagugcccaguacccacacggcaucucacaccugucuguaacuccaguuucagggaaucugauauuucugcuauucucuggcaugagacauauacucuuuuaaaaagcuaaauuuagauuuuuaaaaagugacaguaacucuugggauaacguuauaaucuuuguuugcuuuagcuacgcuucuaaggagccuguuguuucucgggaaagcucaaauaacucuugguuuuauuuuuguaggcucagaucaccaugaaaguaauccaaggccuauauaguggggucaccacaguggaacuggacacccuggcugcugagacagccgcgaccuugaccacgaagcacccugacuaugccauccuggcagcaaggauagccgucucuaacuugcacaaagaaacaaagaaaguguucagugguacgucugguauaaaaacaugagaaagcguuuaauagugucauaaaauuauaggaauaacaagugaauuuuaaagauuaugucuuauuuuuaaaagcaauauacaauuuaguggcagcaugggaacuagaacuugcuguuucuccauguagcugagcuacugagugaaagagcauaugcguguaugugaguguguguuguguugaggcagggucuuauguaaccugggcuggcugcagacucaguuuguauccaaagcuggccuugaacccuuuuuuuuuuuaaagauuuauuuauuuaucguauauaacuacacuguagcugucuucagacaccccagaagaaggcaucagaucucauuaggggugguuguaagccaccaugugguugcuggaauuugaacucaggaccuuuggaagaacagucagugcucuuaacugcugagccucuccagcccuggccuugaacucuuaauucucuugacucuauccaaguucuuagauugcuggcagaugucaucguauugucuuuugaguuucuguucuuuuuaaacuuuuuuauuaauuuuaaguuauguguguuuguuuuguguguuuguauguguauggacaaauguguaccacagcaugugugugaaggucaaaggacaacuugugggaggcggucccugggauugaacucaggucaucggguuuggcggcaaauacuuuuucuguuaagccauguugcugaucuaaggucuauuuuuguuuuuuguuuuguuuguuuguuuuuguuuguuuaaagaacuaaaaaggaaaaaaaagaaagacaaaaaaaacuaaguggugagaagucacuaauagucacuugggaauugcugauaagcuauaagaccuaacauucauuuucuuugaaagaauauuuccuuuauauauaauguauuuuucuauuguuaaucaacagagguauguuuguugaguauuugcucugcuaggugcugaaguggguugguacuaagcaaggauugagagcccauuguuuuaaaacagccguuccgugguuuugacuuuauuacucuucucuucccucagaugugauggaggaucucuacaacuacauaaauccgcacaacggcagacacucucccaugguggccagcucaacacucgacauuguuauggccaauaaggauguauguacagcauuucuuugcugguggaaaauuuucaauuuuaaaauuuuuuaaaaauaauacauuuaaggcugggcaaugguggcgaaugccuuuaauuccagcacucaggaggcagaggcagguggguggugcccacagaggccagaagacaguauuggguucagauuucccgggacuauuaaaguugugugugguucugagcuaccauguggguacagggaauugaacccugguccucugaaagagcagccaugcucuucccacccaccccccccaccccccaaaacaggguuucucuguauagcccuggcuguccuggaauucacuuuguagaccaggcuggccucgaacucagaaauccgccugccucugccucccaagugcugggauuaaaggcgugcgccaccuccguccggcugagcaggcgugcucuuaaccacugaaccaucccaccaguccucuuuacaagaccuaaauuuuuaguccuuguggaccugggaccucuggcaguccucugugcuucugccuugugagugcugggauugcaggugugggcaccacaccucacccuggucauaaucuugaagacauguuaaaaacagguaacaguugcaaaaccugagccuaaaaaguaaacacuggaaaaugagcaaauacucauagucuaguacuucaguuuuuugcucauccuuagccuguaccuggacuugacugcauaaaugcccuucaaaguuugacagacagaagcuuuuagauaauauuacggcugauacgaucucaacuaauuauuuuuguuuucuucuaaauggcuuuauaacuuaccaaggcucuuuaauaaugaccaauucuauaguauuuucugccacaauaguaauucauguuagcuaaggaccaugaauuuccaaagccuauaagcuacuuucucuuuguuuauaauacauaugauuuuguucuguuuaaaguaggcuuauugucagaaauuugcaguugaaaauguugauacaugcuuaugauccuagcagucaggacugucugugcaaguucaagaccagccuacuggucuccuuaguccaggcuagucagggauacauagcaaauuucugucucaaaaauaaauaacuguacauauguaccauaaauuagugugugguaccaauauuuuaauauuaacuaguaugaaagcauguuggguauccuauauuaguuuuaguucuggacggagucagcugaaaacauuagaaguugagaaaguaaguuuuauuauuuuaauuaugaauucuuuuucuucagcgccugaauucugccauuaucuaugaccgagauuucucuuauaacuacuuuggcuuuaagguaaauaaauaaagaauggguuucaaauauaugggcauuucuuuuuaaaucaggaaguacagugguuuguuuaugcugaugauuuaguuugaaugcaccuggcuaugguaggguuaugguaguggugauacuuuaagcaaaauuaacguauucauuaaucgcuuuugaacuuuucaaauauuacuuguggauuauuauuaaaauuacauggguaaugugucacugucacuccgaauucuacuguuuucucaauaaccguugauucccuacucugcuaaguguuuaucuaaauauaguguguugcuuacauaaugcagugacuaaggacagggauguuuauaggagacugacuauguccgcucucccauuucuuauucauaagcuauguaauauuaaaguuuuagucuuaggaugggaauaacguucaacauacucuucuggaaauuaauuaugucucaguuagugucuagucucuuacaagcacucagagauguggggacaucuugcugcugcugcugcugcugcugccgcugcugccgcauaccacagcccauaguguuguacauuguugcaugcaagcagggcaggccuuuuccagaaauuggcauguaaucuuugcugaaguagaacagccacaugauaauguucuagacugaagauagaaacaguaaauguuauucuuuucauuuaaaaugauaacauugagagauuucaacuauaaauuacauauccacuguguauuuaaaaacuugagaauucauuggcugcuuugcuccucuagacacuggaacggucauauuuguugaagaucaaugguaaagguaagaaaugaaaauguuuuuauucauuauauuaaauguagagcuuggcacuauuagccuuaacauuccuauuuagacucugaauaacauuuuaaaacauuuauugcacuuguggcuggagagauggcccagguggcucuugcagaggacccagguucaauucucagcauccauguggcacccugugacugucuuuaacagcaguucuaggggauccaaugcccucuuuuuguuguugguuuuuuguuuguuuuuuugagaggguuuuucuguguagcucuggcuguccuggaacucacucuguagaccaggcuggccucaaacucggaaauucaccugccucugccucccaagugcugggauuaaaggcgugcaccaccacaccuggcccaaugcccucuucuugugucugugggcaucagacaugcauaucuaagcaaaacaccauacacauuauagaacguuauuacauuuauuuauuugugugcauggguaugaggagggagggagggagggagggagugugccauaauguacauguggaaguuggaaaccagggauugagcucagguugcuagccuuagcaacaagugcuugugcccacugagccauuuugcaaucauccaaauaaccuuuuguuauuugguuauaaacaaacaugguaagaagagugcaaauaucucuaaauuacaauugaaauaacuguuaugcuuguuuguaaaguuuuuacaaguuucucuugcuguuaauucuuugguucagauguguuucagacuaauuauucugauguguccuauuaucuggaaauuccuucuuuguuuucaguggcugaaagaccacagcauauguugaugaggguuucuguggggauucacaaagaagauauugaugcugcaauugaaaccuacaaccuacuuucugagaagugguucacucaugccucuccuacucucuucaaugcugggaccaaccgcccacagcugucuaggcacguaucaguuauagcugcuuuuuguugcuguugcuuucuuuuuuauuauuuauuuguuuguuuguuuguuuauuuauuuauuuuugguuuuucaagacaggguuucucuguguagcccuggcuguccuggaacucacuuuguagaccaggcuggccuugaacucagaaauccgccugccucugccugccuccugagugcugggaucaaaggcgugcgucaccaugcccggcugcuuucuuuuuuaaaaaauuauuuauguauauuaguguuuugucugcauguauauaugugcaugccuauugcccauggucagaaaagggcauuggaucccuggaacuggaguuagauaguucugaccuaacuaugugggugcuaggaauugaacccaugucuucugaaagacuagcuagugcuuuuaaccaccgagucaacucuacagccccuaaagcugcuuuuauaaaagguuugacuagggaaauaagaaaaagccaggugguucaucacauuaaaaacaaacaaaaacuucaauuauugccugcucugauuaaauaauuuguauuuugggacaaucucugacuuaugggaaauaaguuggaaguaaaugcaguuaaaugagaacguuauacaguuggucgugguauuuguacagcugacugcuuuagaugcugcugaacagaauguuuuugauagggaauugcauauugguuauauuccaagaagauuguuuaaaaaaaaaaagaaggcuauagcucagagguagauuaugugcuuagcaugcacaaggccuuugggucaagacuuuucagcacugugaaagugauuaguacuuggagcuaguuacaaaaugccugcaguaauuuauuaauuuauuuuaaaaaucauaaaaggauuaaggugaaaguagagaggcagauuccuaagacacaugggaaucaaacugauagaguuugugauguucuaaaucugcauuaaguuugguuccugagauuaugggcagaguaacaggacggcuuagcugugcuuagcugagaaagggauccccguuuuacaucuggaguaagggaaaagaacgcccuuagcaagucuguguguuccaggaagucagggauaugccagugucuguauacauaucucauuguacuaacacuuauauaacucauugcuguuuuauaauaaaauucacuagcaaaacugguauaugaaauaaccuccuuaauuugguaaaagauaaccacuaaaaacuuagucugggcuuaaagagaugacucagguuaagagugcucguggcuuuuguagagcaccuacuuuuggucuccagcaccaauaugguggcucacaaccauccauaacucaguuccaagggaucugacgccucugaccaggcaugcaugugguacacauagauacauacaagcaaaacacucauaaaauaaaauaaaacuaaaaaaccaaaaaaaucaaaaaaaaaaacccucaaucauuagaucuguuacugcuuuuaguguggcaguggaggucugagcggguguuguaagauaagauguugaaaugauugaaguguuugaaaaauggaagaauaaagaucacagauaauauuuuuacauaaagaauucagaauuaucuauggacaaauuagaauuaaggagauuuuagcuaaguacuuggauauaaguucaauagaaauaaauuuauguguuccuguauuguagcauuuagaaaauuuaauuuucugcuguucagagccagccaugaugguuaugcuugugaucucucaggggguaaggacagaagaauuaccauuuugggaccagucugcucucuguagcauauugacagccagccugagcuguauaggaagacccugauucuaaacagcaagauuugggccucuagcuuugugguagacucaaggggccuugaguuugauuccuagcacccaacuacucaagaaucuugcgaacauuggaaaugguagugcugagguagaaggauggagaauucaaugccggcuugggcuaauaugcccucauaaacaaauaaauagaggggaggaagaauuuuagcaguuuuuaaaaaagcaaguaaguugaaaauaauuuaaugaccaugaacaagcgcacggacauaugggauaauuaugcaauggaaugcuuuacaaccaugaaaauaaguuaagacuacauauuauuagguauggauugcuauaauauuuuugaauuaaagacaggcuucagaaggguaacuaauuaagaaauuacaauuagggucuuuguggcaucuuauuucuugagauugguguuauauagacauguguauauaaucuuaaugccugaguauuuuauagaaagucagugaauagaaucuauuugaguccuuuaacauucaagaugacaaagagacccugguagacuaaugcuagggaaugugagugugaagagauagauccaaaguuuaaguaggugggacauccuuuuuaaaaagacugcagguuggacugugguggcacgggccuuuaaucccaguacuggaaggcagggagaucucuguguucaaggcuagccuagucuacagauugaguuccaagacagccagggcuacacagagaaacccugucucaagccccaguacccucgaaacccaaacaaauaaacaauaauaacaacaaaaaagaccaagggaaugguauuuuuaauguacaugucaaagaauuugcugacuauaugguauuuguuuucaaaaaaacuucauuuuuuuaaggcugggccugguucuggagauaggugugaucucugaguuugagaccacccugguacguagugaguuucaggauggugcuauguucaggaccuugucucaaaaacaaaaacaaaaaaccaaggaacuucauuuuucuaaaugaauccuggcacauaaguggucugguaaaaaccaggcuugauaguuuaggcuuaccuaucagacuuccuucuggguuuaaugucuaagguaguuaacaguuaauuuaauuuaaaauaauauauugauguuuuauauucaguaaaagguguuucuccucauauauauaaaauaaauaaaucuuuaaaaggggggggaggggcuagagagauggcucagagguugagagcauugacugcucuuccagagguccugaguucaguucccagcaaccacaugguggcuuacaaccaucuguaauggaucugaugcccucuucuggugugucugaagauagcuacauugugcucauauauauauaauaaauaaaucuguuuuaaaaaaaaagguguuuucccaucuucugcaaacacuuaggagcuuuguagacuuuaaaucucuuguugccugauguagacgucuagauaaucuaaucacucuaugucacucacugacuuccuugcuuugguugucuuuuuuuuuucucacuguagcuguuuccucuugaguaugaaagaugacagcauugaaggaauuuaugauacucugaagcagugugccuugauuucuaaguccgcugggggaauugguguugcugugaguuguauucgggccacugguagcuacaucgcugggguaaguguuaaguuguaagacuuuugauaucacuccuaugugugcuccagaggccauacugucguaaugcuggugcuugggaggcuugggcuucugcuaauuaacaccuguuggugugaguaggagggagguauuuugcuucuugcuuccuguguuguauuggagggugaggcugugugagaugaucuauguaguauuuuuuugcucagauuuuaaaauuaugauuuuauuuuuuuugguuuuucaagacaggguuucucuguguagcccuggcuguccuagaacucaaucuguagaccaggcuggccuugaacucagaaaucugcuugccucuuccucccaagugcuaggauuaaaggcgugaaccaccacugcccagcagaauuaugauuuuuuaaaaagcaauaauaauagcuaucuuuuuguuguuguguugaggcagggcuucauuuuguagacugggcuggccuggaacucagggggaucugagccugugucucucaugugcugggauuaaagacauguuaccacugugcccagccagcuaucacuuauugauugcucacuaugugccaagucuguuccauauuuuauaggaauuacucauuuuacuuacuguagccuaggauacagccaucaauccagucgcuugcuagcaacuuuguuccuuacaauaauccaggcaccaguguuuucauuuuucacaugaagaaagugaggcuucagaguuaguuuuuuucugugucugucacuugcuguaugguagagcugggauuccagcucuagacacuggaaagcaaggugaugaaaagugcagggcuuggauuuccauacuguauuuuucccuacuggcaguguggccuggagggaguuacgucagcauuuuuguguguaaugugaaaaaacauaaacccuaauagaaucagguucucaaggaaauuguccuaugauauauuggggcguguaggugugcaaugugucuuuuuuguuuguaauaucuguaauauuuuguguauuuauaucuaucuguccauuuuguuuguuuuucaagacaguauuucuguuuacuaucugucugucugucugucugucuaucaaucaucugaauuuguagagugagccacagcccacuuaucuuuucaaacucuuucaaagauuuaccuugggguuuagaaaauucuuuaaagaauugaaagguauuuuuuagucauaacacuauuugcuuagccuuauucuauaauccauucauugcugagucuccauuuuguuaucuugguauguugacagcauagcauaucauuuucauuauguugccuugaauucuuuggggggaggugcuaucauaguauguuuuguuuucuuuuaugguacccaaaguauaucuugguuuguuugauuuuuuuuuuuuugagacauuuuucuguguagcccuggcuguucuggaacucacucuguaggccaggcuggccuggaacucagaaaucugccugccucugccuccugagugcugcgauuaaaggugugcaccaccacgccuggccggauuuuuuuuuggauguauuauaucucauaaaguagauaaaguaggguuguugagguagcucaacauauaacuuacauaacaauauuuuguuguuucuuauguuggguauuauauuuucauugcugagguggggaguagcucaaacuucauagauggguuccuaggaaauuagucaguguuuugaacagaagauuggaaacaguuuuuauuuuuaugcuauuccuggcuuuuuuuuauuacuugagaccuauaucuuaaucaggugccuuuauuuuuguccuuucuuucagacuaauggcaauucuaauggccuugugccaaugcugagaguauauaacaacacagcucgcuauguggaucaagguggaaacaagguauacuuuguuauggacaagggcuggaaaucagaauuaagucuuuagcuauacuacuugguucaguuauauauuguuuuacuuuguuuuuaaagauuaauuaauuaauuuauuaauaugauuaguauguguauaucuaugugugagcaugugcauguggguguucauggaggccagaagaaggccucuggagcuggaguuauaagugauugugagacacccaccguugguacuagaaacguagcuaggaacuaaguucuagaguucuggaggccagaagaggaugccagaucuggaaguggaguuaugggcuguguugugagugugaauguggugcugggagcagaacugugauccuuucuuuguuaaagcagcaaguggucuuaacugcugagccaucccuccagccccaaauuuucucugucauuuaugaaaaauauuaguaguuuacuuuuuugauacuguuacuuauuucacuuaauuuacucacugaucauaguaaagaugaaaggagacauuaugcaaguguuuugcaaacuaugaagcuucuuuguuuuguuuugacuuggaugagaaugcugacuuauuuaccuuuagcgcccaggcgcguuugcuauuuaccuggagccuuggcacuuagacaucuuugaguuccuugacuugaagaagaacacaggcaaggaagaacagcgagcacgcgaucucuucuuugcacuuuggaucccagaucucuucaugaagcgaguggagacuaaccaggugagagggcuccucucagcuugguucuuacaagcuuuguucuucaguccuucaccucugugaugccacagacggcaaguucucgagagucgaugacacuugaccugugcaagcaggcagaacuacaguuuuagacccccacucugacuuggacagcagauuuccauggcagucccuuguugcagugugugggaagggcuguggcugcuacgugacaucucucaugcuggcacuccuucuuggcaggacuggucauugaugugucccaaugaguguccuggucuggacgaggucuggggagaggaguuugagaaguuauaugaaagguaugagguaacugcuaauguugcaagcaucaucagaccuaacacuucucucgcugggcauccaaauaccagaaguguguacgcuaagggcgaggcgcuugagaacgcugcucgcuuuucauguugcuaggcaccagugaguuugaucccuaccaguggaaaaacagaaaaauauuuaaucacuagcucauuucuagaaaucuuugaaaguaucuagaagaagaguguaauuuuuuuuaaagauuuauuuauuuuauguauaugagcacacuagcuguacagauggcugugagccaucaugugguuggugguugcugggaauugaaucccagcucucucuccggcugguccuacucacuccagucaaccccgcucucucuggcccaaguguguguaaauagacuguagcugucuucagacacaucaggagaaggcaucagaucucauuauggaugguugugagccaccaugugguugcugggauuugaacucaggaccuucgggagagcaaucagugcucuuaaccguugagccaucucuccagcccgaguguaauuguuaguuugauuuuuguuagauguuucuugauuuuuuuuuuuuuuuugguaccaaaauuaguauuuaucuucuuaaaauuuauguacuuugcauuuuuaauugauccuuauuaaaacugugauuaaagaguagcuaaguuauuuuauaauauaguacuuuuuauuauuauuuuuuaaauuacauuuaauuauuuugggcuuggggacaugagugccacagugcauauauggaggucaggggacaacuugcaggaguugguucuuuccuuccaccguaugggucccagagaucaaacucagguuaucagguguggcagcugucccccuggcucccgaguaggacuuuggugauaggaaucacaguaacuaggacacacaaguuaaaauuagcacagcacugaauuauguuuuguuuuguuuuuauuuuuuugaagguuaaugauaguuucauuagcguuugagaaaaacaagagggcaggcaagcuauaaauauuaucaacugcaaggagggaucuaaaagaggaagagagaaagccaugccccuuuagguuagggucugagaaaguaggcagcuuuagcagugguguucagugugcagcugcauguaggaggagaagcgacuucagagaaagaaagccagagcaacagggaaagcaaaacagaacaaaaagcaaaaguagaugcaggcugcguggcagaggcucuguaagcagcugccagucuugauggugguuuuuguuccuuuugguugugaaaaguaguauugacugggugggguuaagggucaucugaaggacucuaaagcugccugguuuucuguggucuuagcggauagaaaauagauuucaggguuggagaaaugguucaguaguuaagaguuuuugcacagucuugaggcccugauuuagaugucagauaacuagaugacaagccagguguccuggaaauaccaguaacucagcucuggcuuccgugugcccaggcaugugcccaggcaugugcccucacaacacucaugcacauauacuuaaacagacacacaaauaaauagaaccaaccuuuuuuuaaaaaaaaaaaaagucauucauuuuuuucccucauuagcaaagcuuugagaauuugccuaauuuuauauuuuucuguauucuuccuagggugugaauguugagauaauacuagcuuugucuuucaguuacgagaagcagggucguguccgaaaaguuguaaaagcucagcagcuuugguaugccaucauugagucccagacggagaccgguaccccauacaugcucuacaaagauuccuguaaccggaagagcaaccagcagaaccugggaaccaucaaaugcagcaaccuguguacagaaauaguagaguacaccaguaaagaugagguaggcggagagacugacugccuagcacaccgagggacuggagaggugguugcugcuugucgcucccucacugaacccagugguuauuugaagugguugaaggagauuuuguuccccaggacugaaaagaaauuuugugguggaguuauguuaacuaagcugcauuuuaaaaacaauaauuuaaguacccgggagcaaggagaacggaaugcaccagggaguacaguuaagagcugggcagugguggcacacaccucuaaucccagaacagaguuaggcagauagaucucugaguuugaggccagccuggucuauaaagugaguuccaggacagccagggcugcacugagaaacccugucucgaaaaaccaaaagaccaaaaccaaaaccaaaaaccuauuucaguauucugaauagugcaacucaugugacugauagcaagaggaguagaauccaugggguauagaaauuugcugauaaaugaugggaaaccaugauuuuaggggguggggauuuugcugaguuauaaagagguucccaguaaagacuaauacauuccuugaguuugguccucugcaccaguguuggggugauuguaaguuuucacaucugauuguuccaaaggcucuagugaucucacugauacaggaagaagaagucaggagugugugugauucugacaccuuucucuggauugcagguugcaguuuguaacuuggcuucucuggcucugaauauguaugucacaccggaacauacguaugacuuugagaaacuggcagaagucacuaaagucauuguccgaaaucugaauaaaauaauugauauaaacuacuacccuauuccagagguauggauagauuucucugcuuuauugaucauuauugaauccagauggaggacauuugucuuagucuggcuguccccagaguuggugugagagaaggaaaaugaaaagguuguguguaaguguagaauguggccuucugaguucagugauguuuucuuuucuuuuuuuccuaaaccuuuuggcacaaaggcacacuuaucaaauaaacgccaucggcccauuggaauugggguacaagguuuagcagaugcuuucauccugaugagauaccccuuugagagcccagaagcccaguuauuaaauaagcagaucuuugaaaccauuuacuauggagcccuggaagccagcugugaacuagccaaggaguauggccccuaugaaacguaugagggaucuccagucagcaaggguguaaguagauggcugauuuucuguugccugugaguauggggaaugagcugaauggccccuccuccaugggaccugggagggugugcuggguugugagagggucuguacagauuuaguuaaggaccuugagauggcauuguuuuggauuauuaaggccuagauuuauucaagugcgcccuaaauccagcaaucccuguucugcaagagaccgggaguuaugauauucccaaaaccuguucguucacacuaguagacuaggagauagauuaauuauccauggucugggacaccagggacuggaaucuggggaggccucuuagaguugauuuccuugcugccuuugucucuucuuuauaaagauuuaguuuugaaguuuguucugauacuuaggaauucuaauaugugauuauuugaaauuugguauucuaggccaaauaaacagaugaaggaagcaaagagcagagugugcuuuauuauaaaaggaauguaucucuuaaaauguuuaaugacuguuaagauuuccuaguuugucgauccucaggaguguggugaggucccaggcugcuucugagcaauaugcuuaauggagccaugucuaagacucagugcagcuaacgucccuuaauguguugacuacaagaugcaguggcuggaauguggggauauggcaguuaguuauuuuaaaaaaauuuuuuuggucauuguuuuaaauugccccaaaguaacaucauaacugugggguauuuaucucuuagauucuucaguaugacauguggaauguugcuccuacagaccugugggacuggaagccucucaaggagaagauugcaaaguaaggagugagguguaaaggacccuggaggccggaggccgggcucuucuggcucuucaggaguuggauaugcuagugugaccucugaaacuuauaaauuaucuucugaaauggggcuaaagugaccuaccacagaaauggcuuuggaaaguauaagaaaauaguuacaugaaaguuguuuggcauagugaaagccuuucaacacacaguaggcauuucagugggaguugauguuauuugaggagcugaacaaccaugcuagucaauuuuuuguuuuauuuugguuuuggguuuuuuuuuagauaagugucuuacuauguagcuccgaaugcccuggaacucauguagaucaggcuggccucaaacuuggagauccuccugcuucagcuucuugagcacugggacuaaaggcaugugccaucacuaccugacccaaauaggucuucguuuuaaaaauguuuuuauucuuuaauuaauugauuuaauuuuauuuuguguguguguauguauguauguauguauauauacacacacauacauacacgcacacauguaguuuuucauguaaaugugauugaauaugacauauucugagacuuuuugguguuugguuuagagaucuuucaguguaguguaauuacaauuacugaugauuccguaauugggauugagcaaguaugacaugaaaguguuuuccuaucuauaaccaugauugagauuuacaguugaggaaguagagacgugagauaacugauaucuuacaucuagagagugacugagcuuugaaccuaguuguacaaacccgcucaggacccgaggcucaacuuaugguccguaagcgugggauguuggaaagauaugcugucuguuagaggaacuuaacuaauacaagcagggcagucugugguagucacuggagaggcuugaugaacaguguuuguuuucacauuuguguucauucccaccugcucaggaaagugcuauaguguuggucucuacacacauuucuacuauuuauauauuguauguaugugugcguauauacuggugcacauguggaggucagagaacagcuugaaggaguugguugucuccuaccaugcugaacaauauauaccuuauauauugaccccagguuaucaggcuuggugacagauaccuuuacccacugagccaucuuguagaccguggaguugguagcucuuagacuaagcuguggagaguucuaagaguguucaauauucuuguuuaaacacucuuggcacuuaaaagugaaaaaaauuaauuuuuuuuuuuuuuuuuugguuuuucgagacaggguuucucugugaaguccuggcuguccuggaacucacuuuguagaccaggcuggccuugaacucagaaauccgccugccucuuccuccugagugcugggauuaaaggugugcgcuaccacgcccggcuaaaaauuaacuuuuuaaaaacuaguaagucuggauuuucucugaguguaaugugcccuuuacacaggauaaugaggauuguagucauacaugacuaauccugaccauuuucacagcauuguuuuacgaaggggcuggcagucauagaggcacacagagaagaugagugggguugaauggaugugccuugauucagaugagcugcugaggacugaguucaguuuuuccugggcaaaacagugcauugaguguucuaugugacuccuaagugccacagagcaaguggcaacaguggggacuuuaagacuugcucacaguuacaguugugcugguucuguuggugcuguggcauccgugccguggacuguauccugcuggaguuuaacgaagucaguaugugaguuaaaugccucugggauguucuccuagcaucugucuacacuaagugaugcagaguaguugcccucuggguagaguagcacgaaucucuaaucucucucucucucuuuuuuuaaagguaugguauaaggaacaguuuacuuauugccccaaugccuacugcuucaacugcccagauucuggggaauaaugaguccauugagccuuauaccaguaacaucuacacucgaagagucuugucaggggaauuucaggugagaauuuuacagauuuauagaagcucuucugaaaacuaauaguaaaaacuuacucauacuuugcuuaaacaacuaacauuaggaaagucacccuuuuguuuguuuaaaacagucucagguagaccugucugaccuucagcuuacccuguagcugaggauagccuugcacagaucauucuuucuccagugcucaggugcugggauuacaggugugcaccaccaugccuggccuagucagagucaacauguggcuaaaauuggggcagggugguuaagauagggcuucuuuguguagcagcccuggcuguccuggaacucacuuuguagaccaggcuggccuugcacucacagaaauccaccugcuuuugccuccugaaugcugagacugaugguaugugcugcuaaccacccagcuuuuuggcuuuuuuagaaaagccucacuaugaagaucaggcuggccuccaauuugccuacuaagugauccuccugccucugccuucucuguacuugguauguuucaccacuggcugcaugacguuuuguauuugcuaccucacaugcuucaguugggauuguaaagguguccauagaagugucacacaggcaugguggucuguauuuauaguuccagcacuuggaaaacugaagcaggaggcguucuaguuuuaggcuagccuaggcuacauagcaucccuucucccccuauuucuuuuuuuuuuuuuuuuuuuaaagauuuauuuuauuuauuauauguaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagcccccccuauuucuuuuuaaaaaaacaaaacaaaacacaacauuaaggaguaguucucaggugaagagugguggcuaugcccauaauucuugaacuugggaaguggaggcgagaggaucagaagguggagcucagccuuggcucugggcaguuuacaguagcuugagcuauaaaaugguuaccaaugagaauuuaugugcugcaagucagaaauuacuaauuaaaacaaacaaacaaacaaacaaacauguggauuuccagguguccugaaauaaguuuugugagguauagggaaguugcauuucuagugauuuuacucaaguacuauuguucagucacuuuagaaaaccaaagaagaaucagucucuauaaacuuacucagcuuagacacugccguuucuuuucuuugcaaaugucauauucuuucuuuagcuuuuuaaaacuuuuuuuggguguggggugaggacagcauguucaugccauggacagaggacaacuccugggaguucuguccuucuaccaugugaguuccagggaggaaacacauaaccuugaauggcugaacuaaagguuuauuuuauugugugugucagcgggagugugcaugugugugugcaggugccuugcaguaagaacaggugcuauuccugcagaagacccaaguuugguucucaucucccacacugaaggcucaggggaguugauuugucuggauaugcacauacauacagucaaaaccuuaaaagauagauaaucugauggauauguaugugaugcauagauauguacauuguagagugauuaucacuauacacuguuucuuucauaauagaugucaagaccuuaagggucuuguagcuuuguguggugaaauguccuccucaguuguguaaaaauagugggguuuauuaggggaucuaauaaguuauucaucugucuuacuuauuuuaggcuucaggccugggacccuuuuguagguuguacugauguuauuuuauuucuugacauguuuucugcuuuuuucaucagauugugaauccucacuuacugaaagaucuuacugagcggggcuuguggaaugaagagaugaaaaaucagauuauugcaugcaauggcuccauucagguacagacuggaaauaacaugugcuucuaggagcugagcugagcauuguggugccaugucccuucucccagccaggcagugcguaggaaaauggccuuucacuguggccgugcagguucuauuaaugucucucugcauuguugugcuagaauugcacacaucuuuauauggucuguauuguuucuccgauagagcacaguucccaguuuuucuguacaaccugggaacuuuuaaaaccuugaagcuuggguugaauuuauugcuaaguaagucaggaauucuuaaagcuugaaauuggaguucaacuaaaaaaguguggggacugagacccacaguguagaagguaguuagguagcacuuaacaauaaagugacugcauuugacccacaggcauuugggucucaagauagacaccuuagccgggcagugguggugcacaccuuuaaucccagcacuugggaggcagaggcaggcggauuucugaguucuggucuacaaagugaguuccaggacagccagggcuacacagagaaacccugucuuggaaaaagaaaaaaaaaagaugcuuuggccagcuuggcaacuuagccucuuucagauucucauggcagaaaguguagcaucagucagguuguguguuucaauacaguuggccauagaacaauuuaaaggaguuuaucucaguacuucguuugaucaggucccuguaaaguccugauuauuuguuuuucuuucauuuagcuucgcucuuauuuuccuuuccuuuccuaacuaccucuagaacaguaacuguuuuguccauaagccaguucaagauggaugucuaagucacugcaucacauuuauauuugguugguaaaaugagauuuuauugauguucuaagcaagagauaaguaguuugggcuaacuugcuauaagcauucagauacuaacucauagcgguaucaggucugcaggaagauccaacccagcauccuugcaaggauaauuagucugcuaguuauauugcuuucuuuaacuggaauuaaagcaacaacaacagcacauaguuuuccuuuuucagagcauaccagaaauuccugaugaccugaagcaacucuauaagaccgugugggaaaucucucagaagacuguucucaagauggcagccgagagaggugcuuucaucgaucagagccagucuuuaaacauccauauugcugagcccaacuacggcaaacucacuaguaugcacuucuacgguuggaagcagguugguugagcacucugaggaggacuuaauugccagcucgaaauauuucagaguggaauaguugcugcuagcugccugcuauaaaguuuuuucacuucaaguguuaaaacucaugagugguuuuuaugccagcucagacuuugucuggguuuucuuguuucaguucagcaguuguacacugccuggugugggugcuggggauugagcacucagguccucuagaaggcuaggacgguucuuaauuacugagccaucauccagucuugguuuagaauuuuuacucucucagauuucauacaguguguuuugaucacaaucacccuuaaugacucccagaccccuuaccucucaacuccuacaucugucugucugucugucaguuuuuacuguccauauacuucugguuaugggaccauccccuggaaggaacuuucucuuccuaagaaacccuucuuacccccucaggguguggcucaugaacuccaugcuagaacagugacucgcuugcagccagagacaccuucacucuaaaugucagggucucuggcucucacagucuuccugccccuauguacuguuucauaagucuuucuuccucuucaacugaccucucggguccaaaccccuuugccauuuccaaaguagcuucacacugucaguccacuauucaaaacguccauuguucccaacuuuaucccaguguaugagccacguuacacuguugccaacugcaaagugcugugauucuguuuucccuuacauucuuauguccugacgagugugaggccuucuguggaauuacagagugacuuucuuacuugcaugcuuuugucugucuguccugggaaucguggccaagaagauuacccucgugaaggauuuagugcgcugcagaagcagccucauccccuaaaugguuacaggcuaaggcaggcgugugcucuguacagaccugcaagcaguacacguaaaaguaaauacaaagaaacaaaaagauuugcuauuccaaagaggcaacauuccuauuucagggaugaaaaacucaagcauuuuucagggugcuuuguagaggagauaaaauuacaaguuuuuuuaaaaagauugguucauaggaauacauuuaaagauuuuaauaacuaguuuuguaacugaucacuugggaauuuuaaacaaagacugucuaguguucuggaguucuuccuaauagcuacguuuucuucccuugcaggguuuaaagacuggaauguauuacuuaaggacgaggccugccgcuaauccaauccaguucacucugaacaaggaaaaacugaaagauaaggaaaaggcacugaaggaggaggaggagaaggagaggaacacagcagccauggugugcucuuuggagaacagagaggagugccugauguguggauccugagaaaaucagggccugggagacgcagcgggcucuccugcccgccgaggcagacgauuugagcauagauaggauaguggguuugcuugguuaucagcagcucugcuuggacgugccugccaggacagggagccacgacuuacaguacuguuucuacacaguguaaauaucauuuuuaacaaacagaaaaccaaagccagcuuugauauuaggaaucaaaguagaggcuuugggaauacuaaagagccuuccugcaaauuagugaggagacuuaggaagucucgucucuccagcuuucccugccuggccauucucaguuugggcaaagagauuuaguuugauuugacugauugccuagaaguaaaaucaagcaauuacucaucagcuaaagaccuuugucuagacaaacuucuauaggucauuuugaaauaaacauuucuaaguga

SEQ ID NO: 12394 - RNA, 1583 nt, Mus musculus
uugcuuuuauugguggugaaccuaaauuaggcugaaagcuccucugucagaggacacaggguucagacuggaaagccaggaaggaagcuuuggagcugggcaguggaugcaggauucucuccuuauuuggauguaagugcugcacucuauaaguacuuauuuugggacaaggcuuaagcaccgaaugggacaggcagccccagggaucaggcugcgcucucuauuugaagcacggguuucucaggaucuuccuugguagguugaggagguucuggcuccagggcagucucgagcucggacuccauuucaggcugagcugcaggcuggccuucugaugggccuucagagcuccggacaggcccuacgcguggcggcuugacuggugugggcugugcugcuuuacgacuggaaagagcccuuuucaggcuuugaacuuucuguaaaccagugcggcgcagccgcugagcccuggacuccacuggcuccucuucagaacucucuccaacuucauccucuggcugaucugggcccagcaccaacugguccuccggacccaagagcucugggacuuucuggaaggcgcgggcuggaauuucagucuccuccuaaaugugaugacacagcuuuugauucucugauuugacccuggcacuuagccaggaccagccugaaacucucuugcccgcccgccaagggaagcuacuccacccuuugcaucugcacuaggaauuggggccaaaauagaggaaugggaagaugggggauggggaggauggaggagcagagagaugagcaaagagggggaaaguggaccuugcaaguuugcaaaguggaugaaaccguguagaguguaacagcuguauaggcgcuuggaggaggcagaguaacaccuaacaguuaguuccaugugggugcgacugaccaaauccgcagacuggccugaguuagggagggcguggguuggccaggcugggagugagaaagggauaaggucgcuguugugagaaagugggugcggcucugagagucuuccacaagugagggcagcacgcugggucaggaauguggagaugcggacggguggguggcaggaguccuucccucggugguaaccuagaggcgaggguugggggcgggagagggaugccugaggucacugaccuugaagagcaggacgugcagcuucccgcgcgccaccagcagcccgugguuggccuccaaccgcugcaccugagcagcgcgacgcacggcccgcuccugggcugcgucggcgugcgagcccacgcgcuccgccuuggccagcagcugcgucaguguguugcugguggugucguggcugcgacucagcgcacccaggccacucuguaugcgacgcacggagcccgccaggccgcccugccucucagccaggccgccuugccgcucccgcagagccuccagcaugguggccaauuucuccagcaaggucaccacggugacugcgugcaccggacccccugcgggcgucucaggcacagguccgggcuccagugcgcucucccccaugaucucugaccaccgggccugcucucccugagaccgau

SEQ ID NO: 12395 - RNA, 1583 nt, Mus musculus
aucggucucagggagagcaggcccgguggucagagaucaugggggagagcgcacuggagcccggaccugugccugagacgcccgcaggggguccggugcacgcagucaccguggugaccuugcuggagaaauuggccaccaugcuggaggcucugcgggagcggcaaggcggccuggcugagaggcagggcggccuggcgggcuccgugcgucgcauacagaguggccugggugcgcugagucgcagccacgacaccaccagcaacacacugacgcagcugcuggccaaggcggagcgcgugggcucgcacgccgacgcagcccaggagcgggccgugcgucgcgcugcucaggugcagcgguuggaggccaaccacgggcugcugguggcgcgcgggaagcugcacguccugcucuucaaggucagugaccucaggcaucccucucccgcccccaacccucgccucuagguuaccaccgagggaaggacuccugccacccacccguccgcaucuccacauuccugacccagcgugcugcccucacuuguggaagacucucagagccgcacccacuuucucacaacagcgaccuuaucccuuucucacucccagccuggccaacccacgcccucccuaacucaggccagucugcggauuuggucagucgcacccacauggaacuaacuguuagguguuacucugccuccuccaagcgccuauacagcuguuacacucuacacgguuucauccacuuugcaaacuugcaagguccacuuucccccucuuugcucaucucucugcuccuccauccuccccaucccccaucuucccauuccucuauuuuggccccaauuccuagugcagaugcaaaggguggaguagcuucccuuggcgggcgggcaagagaguuucaggcugguccuggcuaagugccagggucaaaucagagaaucaaaagcugugucaucacauuuaggaggagacugaaauuccagcccgcgccuuccagaaagucccagagcucuuggguccggaggaccaguuggugcugggcccagaucagccagaggaugaaguuggagagaguucugaagaggagccaguggaguccagggcucagcggcugcgccgcacugguuuacagaaaguucaaagccugaaaagggcucuuuccagucguaaagcagcacagcccacaccagucaagccgccacgcguagggccuguccggagcucugaaggcccaucagaaggccagccugcagcucagccugaaauggaguccgagcucgagacugcccuggagccagaaccuccucaaccuaccaaggaagauccugagaaacccgugcuucaaauagagagcgcagccugaucccuggggcugccugucccauucggugcuuaagccuugucccaaaauaaguacuuauagagugcagcacuuacauccaaauaaggagagaauccugcauccacugcccagcuccaaagcuuccuuccuggcuuuccagucugaacccuguguccucugacagaggagcuuucagccuaauuuagguucaccaccaauaaaagcaa

SEQ ID NO: 12396 - RNA, 113830 nt, Mus musculus
ugccaacgguuuggaaaugugcauuuauuuucaaacucagcuaugugacacucuuaaaguucaacacugccacaccuaccugugugagguuuaacaguguuagggacugacagucggugacagguacguccagugucucccuugccauacccucuuccaggcugcacaaagaaacagcccacauaacuucacagcuagaacaugaagguccuuuuaggaagugacaucacuggugaugcaaacacauccuuggcaaccagacccucaggcucaagcagaaaugccagcuuucaggggcaucuugagugggaaacuuuuauuccauuucacaguuacgucuggaaacacaaggcuggcuuccaugucacuggccaugugugggagcagcugugacucgccuuccugaaccgguaguccaacagugugcuuucagccaugccaucccaaauauggcuaugcucucuggagagguccuuguccucaacugucuuuacugcuggagcagcguggcugcuggucuguaccugaggacgccugcaggcguuggaggccaguggugaugcugaaacaguuuacucauguucuccucaacucucucacccagaaagggggugggaaauuuguggccaaauggacaaugggcucacucaggcuggaucuucuuuugcuguggggaugggcugagacuggacacccccccacccccgcaaaguccugcccaacagcugcucucucuucauucccuguaaauccuggcuuugucucggacgugcuuauguaguuaaaucuccuugagcuguaucuaaggcccuggaagccuccagguaagcccuaccccuguccaugaaaucccccugccuggcucugaaccucauuaccuuuaauggcacauccuugggcuucucuuucucuuucuagccacuguaaagacguuucuucaaaaacaguauuuuaaagugaggccuaguugggguggugguggggggugcaugucucucugaagggacugauugcauggagucagguucuuggacuugaaaaugguguugcuauagucuuauuucauucuugcucucuccgagaaagauaaaaauaagaugagaccaugaaucagucagaaagucacagcuuucucaugggaauagaaauugucaugaaggugacacuacugggccaccucaaaaugucacauguucugggcugcucuccaccuugaauguuuacuuguucuuuuaaccaacaucaaaugacucucucccacagguuugccaugcuagguaccuagacaagaaaugguaagacagaguucuugagggaaaacauccagggagacagauauauaaauaaguuagacaguagauacagcucaaugacuaaaauuuaacaagugccagaagcacuaagaggggugccccccacuaggcuggguaugcaagaguguggaaggaggucacagaggcauguaccaaggggaagugcuuacgguugguccucaagagcggugagaaagaggacuaaggcagcaaagaugcuucugaguuaaaggacagggagaggugcagugccaucugagaaccaugagcagcugaagggucagcugaggugugggguggaaucagaccggaaggcacccagcuggagaaggcacccacaggugaagguguaggagugcagucccuggagccagaccacuauagugugaaugacuuccuagcuauagaugcuuggcaaguugaaacauuguauguguguaugugugcauaugcacuucaugcacugguguguguguguguguguguacuuuuguaucauuuaugcuucuauuuccuuauuugaacauggagcgagugauaucuauuucagauuuuucuauucuugaggacgaaugaauuacugccuauaacacagaugauuuuuggcucacaauacauacuacauaagugauagcaacaaaaacaacgaaccagaaaagcaaccacaagagaagccccaucucugacugaagagagcugcaugaaggaaacugucagcagcguggagagccgccaugcuggaggagaacgcacugccuucagguuaaugcugaacaggucuguggaaggacacauuagaguuggaaaucucaugaauacuguagucccaaggugcauggcagagugagagucagaaguggaaggcacaccuuuucuuacccaagagguggguuaacuguguaggaucacuuucaaacggagcaagcaaccagggaacagacugucaaacagcagcuccaaccuggcauaugaaguggaacgaagauaugauuucucagagguucaaacaucuucagaguguguggagggcucccuguguugguaccuggugacuacugcucuauaccuagugaaaaccaacuggauggcaugacaugggugccacugagcagagcacacuuccagagagugggugucuuugugcacaaacauguguauagucuauauguauacagauucauuauauauuaauucacaucuuccuguuuccuuucuagcauggggcuacuuuuagccugugcauuuuuaugagaaagcuuucccacucucugaaaaaaaaaaaaaaaagguaauucugaaagggagagggaaggcgaaagaacgguugugauacauaaagugggaagugggacaauauguugugacuccaagacugagccuuauggucagugcuggcgccuaaguacaauucuuacugaccaugaaacacagggaggagaaagggaaaguagguuucucacuuuccccugaaugaagggauuucaguucuccuaauccaucugagccaggggcaggacccuucccuugugcuagaguccuuaaugaagguugauucuuuaucaaccaggcacuuucccagagcacaauuugaucuuuuguugaucccuucaaagcaucagguuguugcgaguagcuuccaugaaugacaggagagagccuccuuguuccccaaugggauggguggccacaugugcccgguuugggccugacacacuguacuuaggggcaggguguugggaugaaugcacuagagcagggcaugacuaaggaguccgauguccuacugcucugcuggcagcucuugcuggaguccggagcuccaccaggagucccgcugggcugcagagcagguggaucucccagggggcccaucggccuccucugugcaggaguuauaggaacuguacagcccgagaacaacacucaagaccagcaucacugcggccaucauccagaucacuugccaguguugacacaauuuaggauacaugacuuguaggaaguggaccaguucuucaaguuugcugucaauaaaauauagauagagagguuaguauacugggcacauaucuaaugcccagacccauaguucccugccuggggauacuuccuaugcugucuaaagcagugguucuucaauucaaugacacagagcaacacauggcagauauuauucaaaauacccuuuaaaugagaauuccacaguuaacaucuaaggaucccuggaugauuuuggugccacugguccauacuguaggaggcucaugcagauguuugucaaucucuuuaucuccauccuuuuuuucuccuacucuccaaacccuguuuucuccauuuggcugucucucccuugcaucucucuccucaauuaccacauuuccuuugcuuauuuuccaacuuucucucucucuuuucagcuaaguaaaaagacauugaucagagucccauccuagagcuuuccagagaaaagcacuuuaagcaagcuguauuuuucuccugugucuaaguccaauccuaugauuugcaaagcaagauuauugaggguuaccaaaccaaagaggugaggagagugacugagggcuuccuguggacuccaagucauaacacggacacugaagugcucaggccagcuuccuggcaagcuugcagcuugaacugagagcagguaagaaguagaaggcuugcuaugagucaaaauauucagcaaaugcucucccaagaaaggggccagguccuuggaaugcuuaucuuaggugccagggccacaaaggacagcaguuggucccuuguacacguagggaccccaucaagccauucuagcuguaaaagucaugacaugaacuggaaguggaccaaucucagcugcacaagccguuacaugacagcuuaguauaauugcuucggagaaaaaucaucggcuacuuaugcaacuauuggaaagggagaggcuggaauuacaagcuucccuccuucuagcccuauuuaucuuugaauucuagugggauacagcuggaauccaaaauggagccauuuuucaaguucuaauucugugguccauaacaggcugcugguguggugagaagcccacucuaaauccaugcuuaaagauuuauuuuuuaaauuaugugucgggagagggaauaugcacacuggggugcaggugccuguggcgccagaggcaccagaucccccggaacuggcuuuacaggagguuguaaauucagauccucuaugagagcagcauguucucuuaacugucaagccccuaagucuuuccagaccccaaacucauccucaaucugcaaaagagcaggucaagaucugggugugugauccuuagcuggucacccagauuuuagcccagaagagaaacuggaaauaaaauuaggccagaaauagaaauccucugggucaguuuuugauggcuaaagcuucuauuuucugggcauuauuggaaaaguaaaggcaccggcuuaacuuccaucucaacuccauagaacaagccugagucaguggugagaaacaaacaaacaaaccaguuuuauguuacuuauugugaaucucauuuguauuacauauuaaugccacagacugaauuuagaagauguuggguuacuucacccaaaguuccuccagugaucaacguuuauaacagauuacuguauuacauauaagggagaagaaacuuaaacacagagacuuauaguuuaaugucgaagccuuuaaauaaggggcuaguugcuaggcuuacuuaguucagugguuuuuauuuauuucuauauuuuuaaauuuuauuuaauuuguaugaauuacauacaaauguguauauuuguauauaugaauguaugacuuguauguaugaaugcuuugccugcacauauguauguguacuauaugcauaccugguucccaugagagucagaagaaggcaucagauaucugauggaguuaagacagucaugagccagacugaaguguggacacuaugccccuccuuagaagugggaacaaaacacccuuggaaggaguuacagagacaaaguuuggagcugagaugaaaggaugguccauguagagacuuccauauccagggauccaccccauaaucagcauccaaacgcugacaccauugcauacacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucugcaacccuauaggcggaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguaggggauuggggguggguggguaugggggacuuuugguauagcauuggaaauguaaaugagcuaaauaccuaauaaaaaauggaaaaaaaaaaaagacagucaugagccaugauguguaugcugggaacuaaauuuggguucucugcaagagcaacaaguacucuaaaccacuaggccaucucuccagccccaauguuucuuaaaauguauaaaauagaacauaaaagcucuuguguaugugugugugagaguguauguguuuguguuugugugcgagagagugagagagagagagagagcaagcaagcauacaccuuucgauacacaugaaggucagaagaggacaugggauguuucccucuauccuccccuaucccuuugaggaagggccucugcuugaaccuggaguuccuguuugcuuagguaggcuagaacucagcaagcugcagugauccucuugucucugccacuguuggaguuggaguuacaaggcgugcacaggaugccuggcuugcuaugugagugcuggggucuaagcuccagaccucaugauuguguaacaaguguucuuaauaacugaaacauucucccgcccgcauggaacuuucgguagcuucugcuugcuagugauggaccaacaucucacagaggucucacgcucaagugaaggcuccugcaggcaacucuggugcuaagggguuccagaauggacugagcauugucuagcauuaagcauggcagcccuuggaaccagccugcuuggguuaugggugagagcggggcuuuaugacagugggugugcaguuuauaugauaaaaugaagcugggccgagucugaaaaagugaagcuguucuugcgcugaaggcuaagaccugcugggaggucuugcucuggucuuguaucagucgucuccuccaaagcuuaaaaaacucuaaucaggcaugaaggaugggagucugaaugagguccaggugcuacaaauggccauuauccaguguugcucacaagcuaggcagaaagggacccaggcaaagccuugcuucccugggcuuuugagagacaggaggaggcugcugcuguaugccuacgauuggguuagcuagaucgggccugugcucuguaagccagacuguuuauagucaugugccugcucugcuuaguucucuuuuguccuguguguggacgugcuggaaauucuagccugucuuagauaaauucaaggugccaacagaaggguuguguccaggcuugggcuugacaaaggcagccugguggucugcaaaauaaaugcagaugacccccaagagggaggaggagccggaugcaguuguguggagucagggcugugcuuccacggugcaacuugaggcucuuccaccagagaaggugguguaacuggcacaggcauguucaccaugaggaagcauuuucccuggcacucugaaaaagcucuuuccuuagcaauggggcugacccaggcaggcugagcccccuccggcugguugcaucuuccacaacugggcuccguugauggcaucuacaggcuuugaaauacaguuauggucuuuccagccuuuacuuacuaccuuauucauuacauguaaguagguucuggggcuugccagcaggagguucagaucacagacacugugucugaggucaguggcagaugaucauacaguuaaccguuuugucugcaccaguucuggaccaagccaagggcaucuaaaagaagauuuuagugaaguguuccaagauuacuacaacuguauuugagaaaaaacaaaacgaagcaaaaccagggucuucauguacuaacagagacaguugggcugaauuuaugaaauuagggcuuuucuagaaaucuaggguguugauaguauccuuagagcaguguaugccucuucuuggggacaguuucuucuauccuuaaacacauuccugcgugggauaguccuggccugguaggguuaugacuucauuucauggaaugcccugcaacuagauaaggcuauuucuguuguucuuggucuggggauguaccucaaugggagagcacuugccuacugugugugagguccuggguucaaccacugauggcaguuuugucuuguuuuguuuuuaauauacuguucuguaugguacagugagaccuucaccuagagaggagcaagaacacagaccuucucucuguacgcuccaucuccacuuccacugguuaaaaggagauaccuugaaacagaaaauauuucauccccaaccuaaauugaagacaucaugcaaaugaccaagucaacauagcaggguccugguagagacugaacuuugcuguugaccuaaauuuguucccugcuuugcuguucccucugcuucccuccacuguucuuguuuuugucuaaacccuucucuaggaauucaggccaguuccuuugaucuagacucuuacauggugcaggcuguggaaugggcugacccagaguuuggcugggagucccaucaagagucccucucccuuucuaaguuccuagagacuauagauggcucccugccuuguccaugacuuccucugaccccucagcucugccacuaguaacuugauuuuccucuacuuuccguaguuauugccuucuugaguucugcuaaccaagaauuugaguucuguuggccaagaauuugggccccagaccuacugccauggaggacuggaguuuucauccauuaugugcaguuaaaugacuugcaacccauuugggauccaagcguagguuuccaaccugcuucccugguccuucucguccuccuggguuucuucuaccucuucugguuccucgggacucuccgucuucuguucuuccuccuccuccuccuucaggucuugaaguucuucggucuucuuuaccccuuccugguaucuggagggcaaaaagagaauaauugagucuggaggggagggucagacacaggacauucuugccugaggcccugggggaggggacucaagaacccccagucacugcgcacuuccuguggcuccauacaacaggaaaaagcugggaagcaccgcugaaccgcaacacgacucaugucagugccauuuccccucacuccucagccauccuuccuguuuaugugacagugugacaaacugacugggaaaaaugugggacagggucuacugcugguuguuauccuauaaaacauuccccagagauaagauugcauuuccccuguggaaccuaggagcuucaacuucagggggccccucaucucaggauacuggguuggguauuucucagacaugccagggcuugacauagggagguacccugaaaauauugacagaaccaaugaagggauuuugcucuccuguuuggggggagaacuuuccuuaaaagcuccuagugaucuuggagucacauauguccacgaauacaaucugcuuacuuaucaggcagccaggugucuaacuucauugguugaauugcaacaauuccacccacaacugagugacuaugcacagauacaauugggcucuguacuaagcccaugcuaaguuaaaagugaguuuucuaucuugaguccugggccuuagacccugcucagugcucucucccagugucugauagcuggccaugcuugcuaaugcagcucauuuacagauaggcaaggguggaagugguaggacaagaacaggaagugggaccaccaauuuauacagaagaccagggcaauucuagaaaacacagucgaaggugccccuggacacuguugccaauaacaugacagaucuacacaugugucaggaagccucaggcagcaccaagaaccuagcccaggcccuugauguuuagauauuccuaggcagcagcaucaggccugaaagagaggagucuagucaagucuagccauugucuaagcacauccuaugaucuguuccccuagguaggcccucuucacugaaggagaggcuuugggcccauugacugcuucccgaaaacuccucagaagcaagccagggugugggaagcucucugugccaggugcccucagguugcaaggucugacucacugacucacccuuugcuguaggcuucuuccucugccuuggccuuggucuccuggcucgucuccuccagacagcuugggaguggcacaggggcacccacuucgcaguuagccucugcauuugucuuuccacugugagaggagggaagugcagggcgucauugcagggagagacugcacaucugcagacagaaccauaucuuuggucugguuccugauucaaagaggaaauuugggcucuuucacuggcuuugugguuuuaaaacaucuaucuugagaugagauuccauaaagacaccauccaugaaucuucucuagacuacugaggagacagacccuaccuuagcuucuucagccugauguccccaaauccaacuuuaugcuuauuugaggaagugcugugacaggcaagugucacaggcagcagagcacugccacaggauacagacagagacaucacagguuguccugugucuggugacuuucauuuauuuuaucaacugugcauuggguacgagaacguuacagguacaaggugauauagauuguaagaaggaagggagaaaccuccuuuuuucuaauguagaguuuugcaaaaggaaaagguaauuauacuaauuaugaauuauauuuaugaaagaaacuaucagugacagaaaauggcaaggagaggaugaucacaaagaguggauggucacaaaagaccucucugaggugcugaaauuugaagccucagccucagagaugagguauguaugcagaggucaucugaggcaagagauggaagauaaauagacuuugagaugcaagggaugcugggagacccgaguugcuaagaacagucaauauggcaggagcuaaguuuggagcagaauaaacugcugugcauaugagauguccaagaacagauguuggguggacaguuggagaugccaaagugaggcagagaugaguucuuggcuagagagaguugcuugauguuguaggaacauaaagaacagaugauggauuaauggaaaagggucaggagagaggagcaggcugaaacaacagaaguaaagguagagaggugggugcaagccagaagaggugggaggcuuggggguuagggaaagagggcucaguguguuucacugugucuucugaaacucugugucccuggugggugugauaugcagggcucacaaggagcuuugagguaauggauggaugggcuuaaugaagaaagggaaguaagaaagacacagccacaguuggaguagguaggagagcagggagugacuggcugggcugaugggcuaaauaagugguucuagggugcaagcaaauucaagcacagggagaaagggcccacugccuuuaacuaaagcaauugagaccuuagaaaaguaagagaaaccucuccuuaauuggaacaaagaguagaagugaaggacagaggcauggagaccugacaaaauaugaucugcccccaaccuggugacaaagcugaaauguuguuuguaagagcaaugcuaggucuucuuccgagcaggagagggcagggaucuaagagggcagggaucugagagggccgagaaacagcaggaggcacgagcaucgcuagaguaguaggaaaacaggcacacuagccaauccccucagggcgguugggcaugcuuggaacuugucuaaugaaugaaugggacagaaaguucaaaggaagcagccuaagaggcacagcuucccuauagauguucucugcagccaucuuggugccccgagucccacuaggagugacuagaaacuggaggagccuagaaacuaggcaaagucuaugagcugagccuuccagcagggagcuauagggucaccacugccuuuccuuaggcagggugcaagcuuccagcgugccuccuacucuuggccucagcuuccuaucucuuaacuuuccuucagaucuugaaaauauuuguuucauuaggcuggaaaccaaaauccaucaugaacaaggaagauaaugcucuaaaaauacaagcuaugcauaacauuucuccuccugcaaauuguacucuccgcucccuuuccgagaccuuugucugaugugcacuuuccuaucuguccccugacuggagcaagugaagaaaaacacagagucaagggcaggggcaguggcuaucucugaaguguauuuauaugguagaagugaaauguggccuucacacuuuuggcuucuuuucucuauagcugcccacgucacaguccuuaaagcuagaccgauaugaagagaacuugccagagacaaaccuagauuaaaccccaggcuuggagacucuaacuaaccagccuccgguugagcaagauuguaaaccacccccaggccccacccccacccggcaggaacgaggauacucuaauagaagagauaccuguagcuuccccuuggccaucagacuguugaaacaauauuccccaagaaagugaaaucuccucaggaaucaaucucaugccagcaggagaaaggguuagaagccuaggccauccagagaugaaauuggucuccugggaaaagacaugcaacuugccaggucaccccauggaguugagauuagugggucagugacaggaggaaggacaucuugaccggaacugcugagcugugcagaccucuggcccucaacuuuaaacccaagcccucugucaggacucugaacauauauaggauggagggucacuagaucucuuuguuuucauucccaacauaaccauaguaaauaaguccuuuuucugcuuucuacuaugaauuuggcccuuuucauugguugguugaggguaggugguugagccugacuuguuagagcuuccaggacacggaccuuaacucuaguaacaauuagugugugggaaggcucaaauuuagcccugcuucagguugacgauaaccuaugcuucaacuguucuagucacuguccuugagaggaguuccuuccuggcagauaagaaacaauuccauacuugccugcacucacauuacugaugacgguuggggcuguucacucuggcccacuaacuuccugucaagguaagcuuucuuccuugggccuuugucuccucuggggcucugccugcuguguaaggccccagguaucugcugaaugaaguuauucccaccacauucccauagccagcaaagcuccuuucuccacagacugcuucaaguaugagaggcugggagagccuugguuuuacaggaagcaggaagcugggauuggaggcgggacaaauacagugauaugcaaauguugucguuauuuucugauuuuuagaccaagcuuggaguccccuaacuaucuucacugacuaccuggaaguuucuccuugugcaucuuuaagauucugguuaaauccuccuucacugugggaccuuuguugauguucuacugucuuccaggccaacuggcuaaaguggaucugucaccauacuuccagaacaaagggagaauguuuucacaccugccuguccccuccuuggggcuuugaucaauggaguggccuaugcuugaaaggugccugguguggacuacaguucuuuuguccccccaaccccucaaugaugugccugguccuugccuaugaaguuaguaagaagagagauccuaucuguaagugaggacuuccauaggaccuagaacuuagcuugggcuaagagaauccauacugagcucuguaaaugagagcugagcacagucugugcccuucccagagaucacuggguggacuuuagcauucauccucacccugggaucuugugccuucuuucugggguguucauuaaacuguggcuguuuuuaucacugugcucagcucucagucaccuugaggucuguuuguucagaguaaaucgugagccaagccaguugucaguguauuggugagcaguauucaagccuuuccaaaaggcaggccuugccucuugggcucagaagugcugcuaaaucaucucagcucaguggcuuccuuugauaaacccaagccagggggccugagucaugggacuguucauacucccucacacccacucucagauucuugaguaauaaucacccugggauauaaucuucuccagaauauaaacaauaagggguuagguuguuugcugugcagaucuacuggccuugcugcuucaaaagcacagaagacaacgauuuuaaagaccauagcuaacacggcacugugagaugcuagcaucauggccuguucaugaaacuaaucugcuaacacucccacauccuaguuuugcugucccuuggugagugguccuguauacacccucucguccccuguucuguccuacgcuccauguccaccuacucacugguucuccccaaagacuucucuuuuccacccuugcuucuguagucacaaugaaugcccucugguauucuauuaggagguuaagagcaugagcauggcaucuuuuagguguauaagguuaggguguguaucccugggcaucaucgauaagacagagauguuaauaauguaucuaccucaugaggucugugauggcuuguauauguucagcccaggaaguggcacuguuagaggguguggccuuguuggaguagguguaucacugugggugugggcuuuguccuagcuuccuagaagccaguauucuucuaggagccuucagaugaagauguagaacucucagcccugccugcaccaugccugucuagauuuggccaugcucccaccuugaugauaguggauugaaccucugaaccuguaagcuagccccaauucaauguuguccuuuauaagacuugccuuggucauggugucuguucacaacaguaaaacccuaucuaagacaagauccuuagcaggguuaacaagaaauggacagaaauuaggauaaaaggugccuggcauacagagaaugaguuauagcuaauagcgugacuugucaucaccauuaccauaaccaucaucuuucuuugaauucauugcuaccucgaaaugcugcgcaucuccuauuuuccuaguuaaugauauauccuucaggcuuaacuuuaaaagcagauuccuauggagaaauauuuccugagccaugacccuucuuacacucacacaggguuaggggcacauuuucucauguguuggucccuuagcaaccacacuuccuuaugacaacauucaucacaacauggaauaauaagcugcuucccgucugacuuucccacuagacugguacuccuugagaacauuccaugaggcugaccugagagcacuugucaaaagaaugaaagaauaaaagaccacauacaguuccuccuauuugcaucuuuaaggguaacuaaaaaccucucccuagccauguguuuaaauguauacaucucuagacauuugaugaguugaagagugguuuuuuaugagauggccuacaagagcaagacucaaugcucuaagcucacaugaaauaguauugccagcugcucuguacaguggacuggccacaggcuacucgaucguccuaucaugccuagccaauucucucccuuauaugcaaacuuaggaaauggggacucauuuaacaugaagcucaaugaaacugugaaugucugauaaguuauaacacauuauuucucuucaacaugacuaggcaaacuggaauaggcggcaucugcauauaagaaaagacaugaauuuauauucacuugcaaauuguuucauaauuggccacuuggguaucuacgaugcuuccaguucuauguauuuggagaaaaaagcaagauaguaccucuuauaaguccauauggaggagcugcuauuauuuggagucucuggagucucucuucaauuagaccucccugcccucuuugcagcuauuuauuucgauauauuuccaguaguggagugcaguguauacaauggcgauuuugaguuagccuaagagggagcuacaaacucccuccugggaacuuccgguuugucuugagccuuuuagcuucugauuccaaaccugugaauggcagcaccaucccucauccucacucaguuacucugcagguuugggacuguucugcagauucuccugccaaggacaucucaaguacuuaauaauccccagugccuuggacaucagcauucagcuggccugaacauuaguucugaacauuaguucugauugagagucuaucaaggaaagcagggaccuagaucuucugcuuuggggucuguaggcacagagcugggagggagcccuugauggaagugcucugaaguggacuugugagcccaaagugaaggcugacagaauuucagagaguauaaaugaucauuucuccacagguucagaggccaugaacucuaugugguaagauguguaacuuuagauacuuuuguuuagugacucauuuaucaugucuugguaguuuuucuggauuggucaagaagcgagaggaaagaagaggauacacugcaugauauaaagaagggacuauaugcugguaggugacacaggguauaaauacugggcaaaugcugacagcaaccaaagggguccuuagugggaacuuggcagucacgccuccugagagugaggaacacaggcugagucuugagacagagaguuugggaucuucucugaacugacaucgacaccagcauucacauucucaggcagccagacaacacaaagccuucuaccagcaacagaaaaugaaagugcuucaagguaaagaagaagaaaugaggucuacacuccacuaacugaggaaagacacaaagagagcccugagagguggaagcuguaauccagauguuucccaagaagcaaaugaaaaacaucaaaacauaagcuguaaauuucccccaucacagagaagcagccuuaauggucuggcuuagcaggagaugaccugcaaauuacaaggaggccugugggaagcaggccagggaggcuaacgugucuuccuucccacuacuugauagaaagaagacuuuuuaaaaaggaauuuaccuuucccugugcuuuggggaucuucacccccucuguaauaguuuaaacucauauaaugguucuauucccaaauggaagaaaugcauucaucuuccucuaccuaugguuuugucuaggauuccaggaacuagcagccauuugcugcaagccugaugaugucaucaccaugaaguggccagagucaagggacccacagagaaauagaacccugccacacuggagaagcacacccugggcuugccaucuaagcccuguugaauugagggguguguguguguguguguguguguguguggugcaugcaugcguguguguguguguguguguguguguguguguguguguguguguggugcaugcauguguguguguguguguguguguguguguguguguguguguguguaucccuaaggaaccccaacuacugaggaagcuuucuaccucucaggggcucuuaggcaggguguagcuggcugggucucagagaacuauucacuuccccuagaacuuaaguuucuugcuauuucauuuuuugguuugagaaugagaggaaagaaagcaagucagagguuuucuuuaaggauccccacuguuaaguggagaacagagaaacuuacuuuuccaaaagugcaggcagcgcuggggagacggagaugcugcucuucccauuggacgauucagacuggauggaaacaggacugaggaugagugaggcagccgggccucgggcgacgcuggggaggggcugcaacucucauuucucuuuccuuucuucucucccccuaccccaggcuuuccucugaggcuccauccuagcaggaagccgucaguguuccucugucccauuuccugaggaccacuccuacccaguguggguuuagaauccuugggauggacucacaagcaccacuguucccacagguucuguuccaagcgcaaaccucaggagauuccuaauggcacaaugagcucaagcuggcaaacguuucugugcugcugcacuggguaugggcagagcauaggcuuucuacucuguauccaugcuaaaaucacccauaguggauuaaacaguacugauccauuccagcauucuggggugggacccaugaucagagugguuucagugcagccgcugucauuuuaaaguguaguucuuaguugucaaccacccguauaaagguguauucagaaaccauguaucuaugaaaacaucuguugcuaacuaaccuuuucuagacucgucaaagaaauauuuuuuuagcuuuaaaacauguguuauguguaugaauguuugccugaauguaugucuaugcaccguaaacuugcauugaacuuggaggucauauaagggugcuggauccccugggacuggagauauagaugguugugagcugccauguaggugcuggggauugaaccuggguccuuuggaagaguugccaaugcucuuaaccgcugagccauuucuucaggaccuucaguuucuuuguauuggugaucuggaaauuuucauuucacagacaaaacacuuacaagguaaaagaaacuuaacagugauugguagcuacgggcgcguggggcucugaacugacuugaccaguuucugucacacugaaccucucucucuacagcuguucuagaaagcacagugauuagagaaaucacuugagaaaggucuuuaaaggcuuuaaagaaaaaucacuagauucacaaagacuuucgguguaaaaaagauucucuuauauauuaaaaucgucuccaucuagaaugaaaugcacauuuuucuuugccugucuuuuuaugcccuauagaaauauuuaaaaauaaagaaaauuuaaaugauuuguuuuauuauuguucagaaauaaccauuauugugaugauuaauuuuuaauaaucaacuuaccacagccuagagucaccuaggaagacagccucaauugaggaauugucuagacuagcuuggccuguggucaugccuguagggggauugcuaauuaauuuaagaaggcccagccuacuguggguauaggaagacccagcucuggucuuuggaugugauggcugcauuccugccuugcuauaccuuuaaugguggaugauagccugaaauuguaagccaaauaagccccuuuccccccuaacuuuauuuuugugagaauguuuuauuacaacaacagaaauggaccuagaacaguuauaaaauuucaaaugauuucuuacacaauuuucuauuuuuaaagguacaaaaauagaauuauauauucuaauacaugcauuuauuuuauauagaagcugcuauuucuucucaauaaacuaugggugauaauucuacagaaauucuuuaugaugguauuuacaguuugcugccaaucuccuguugauaagcagugggcuacuuucaggguuucauuguuggaaacaaugguguagugauuuaggacagaaugacacccaguucaugaacuccagcucugcaaucaguuuugcuucagcgauaucugacacaacccacuguaagcugcgaaggugcuuuuuaaauaaaagcauacccuccuuaaagaauuacgguucuguucaaagagguagcugcuuacucccugagccaucugugcuuugcuugagagcacagagaucucuucucagaacaaugggaaggguuacacugggcugcuugguguaccucuaucuauauuguaugcuggaaauguucugccccugcugacccugucccuaucuacgagcccuccauaguagucaugugagggaaagguagaaaagggcagacagcaccauacucaccagagcugguagggaaggcaugggugaagagcucggggcuuggccaggcagguucagggcauuaaacuugggaaccacagcaacgcugacccuccggcggggcauguucugugggaagagaaacgauucaggccuccugucuugagaagaacagcagucaugguucugaggguauuaggaaagcuugcuaacuucuaacauucaauagguaauuugguuuggggguggugaugauguuaggaaucagggugggaagaaugaaucaaagcugacccaaauuuucuguuggucaugagugaucucucccauuuuagaauuugagacuccauucuuugaguagcauccuagauaguauguaaaaaaggucuguggcaaaaccgaaguguauguaucauuucacaucaaguuaaugaaggguugggaagacuaugcccgaguaagaaagaugggguaucaaagaccaugugagcaagugugaaagcuaaaaacccugcugguacccauagguccaagagggaaugaccauuugggugaccaugaagauuucugacacguuucuucugggagcauuggaguuccucugucaugcauaccuuucccauugugagggacauagaucgcgccguucgaggaaccccgucuucuauaguaggaaacagcagaagaaaauugguaugaguuucagguuagggaccaacaguacacagacaggcagaaauuaagccaagcuauucaugggucacaaauggccuugcaggaauggcucagagaucugggcacuggggacccuucacuucugaugcuucacccucuacaaaaaucauaugcagcaaagggaucaacugucuugacuagacauuuauucuaacuccaccagacacuaugagaagcccucaucuuggguuucugagcuucauuugaagugucuuugguaucacccuggaugguaugugaacaggacucugcaagcuugaagcauuccaacucauuccacguucacucaaaggagggacgguugaugacacuauuagcgaggaggaugugauguuaagggugaaaauucacuaauagaagucauuucaguguguuuccuacaccauuacucggaauaacggaagcugccacuuucagaacuucuccuuaucguguauauaaaaugauacaauucauguucuguguucaacacuauaccugcauaagaguacgaccagaaaaacaacugaauacaugaaaaguauuuucauuuuucaaaaauguaaaucuugccccuuugaauauauuuucaaauaugauuuguucaaaauuaucagaaaaguaucaucaaggacaguuggguuugguucagugucaccaacauccuggagccuguguaucugucuguccuccauagccccguauuuuaaguaugacccuugaaaagcaugcugcuauauauuucauuuguucuguuuuuuuaacuugaaaaucuuggucaaccaacaguuucacacugucuauacuucuugugaucauuaacagaguuguuuuuauuucuaucauuucauuuucuauaauuuaccuugauuuauuacuuuauuauuuuuuaauuucuuucccacucuauauauuuguugagauacuauccauccuaaucuuuaaaauagggcuuuaacuucugauauuauuuggcuuuaaauuuaaaauuagggcuggaaagauggcucugcugcuaaaggcuaggcucgcaaccagaaauaaauuuaaaauuaaucaauuauuuccuaaauagugcucaaaacaauaacucucaaaaaccuuuauuagagagcuagucaccauuuuuaugucacccuguguauucucaguuaugcauuauucauccaaccagcauacuggauacuuauuuggcuccacccacaugcuuaugaacuuccuuggucaccauccuaucuugcauucugucaaucugagacccaacacccgccccccaacucuaguauagucuuuaauuguccuuucaguagggaccuaugaaaagaccccuuucuuaucauuauccccagcccuaagccuugcaugaccaccugucuauuuccucucaggacuuugaggggucaaaccacugucuucuggugcuauuguugcucuugagaguugagaauuaucuauauacaaauguucuucucauuacguuuaagaucuucacuuagcuuuuccuuucucuuccccuucccuccccuccccuccccuuuccuccccuucccuucccucccuuuccucucccuuccccuccccuccccuccccucccuucccuuuccuuuuguuugugucugugguguacacaccugaacgugugcgugaauaugugugcguguucaugcuuaaacaggccagagguuaacacugggcaugagacaaggcuucuuacugaagcuggaucuugcuucuucagcuagacuggcuggucagagagguccugggauuugccugccuccaauuccucagagcuggaguuacaggcgcaaaccaccacgcuugagcuuugugugggugcugggcauccaaacucugguccccaugcuugcccagccaggguuugcacccaccaggcugucucuucacucuguauuuuaucuuuuuuuuuuuuuuuugauguuuauauuucacguggauuguaguuuuuuccugauagacuucacuacacugcugaauccagugauuuguguggaagaugcuagguuauuucuuugaagauuuccugugccgaauuuuccccuuauggaucacacggcaaauggauuguaggcucucucccauaccccgugucucaaacacuaucuaccguguuuuaaucacuguauccauucaacugcauuuuggguaacucucucaaaucuuccagucacaaugaacagguuaauauucuggaaggguggugcucaucagaucaggaggaagaaaacuggggucgugugcacaccaguucuuaugggcuucagccagacgugacucggcucauccacaaagcucuccacaaugccugaucuaucuuccagggaagguuuucucaaccuguggucaagaccccuuuagggaucaaccaaccuucagggguugcauaucagauaucccacauaucagauauuuacauuaugauucauuacaguagaaaauuacaguuguaaaauagcaaugaaaauaauuuuauggcugggggucaccacaacaugagaaauccuauuaaaggaagcagcguuaguaagguugagaaccgcugcuccaggagguggaaaauaagacaggggagaggaauucagaauacugagaaaccuccucuaccaugguuaucacaccuaccgagucucccucaccccugaccccuuguuuugaguuguaguucugucauaacuguuauuugauccuguguuugccaucugccuuuccaugucucugcugauuuuaaaauucuaauuacuugacuaucugguauucguaaacacaaucuuauauuuggugggucuacugauuuguguccacgguggacuguuccauuguguauuugcgcugugaacucgucuucauccaggcccuauggaggauucugugugugcuggugcagggugugccucucuguagcggcugacugugcuccuggagaucuccucccgauguucuuuccaauuccccagagauugcaccacuguggcugucauucauguacuuucucuaugaggaaggagagagcauuuguuccucccaggguacagggggaaagaggcaagcuuccacauuugcuuugcugcuggcuggugagggaggcuuuuuauucccugcagagauucuaccucaaggcacagucccuagaagguccuagccuugcacacggaguucauuguccacucggcgggcaccagggcucaaagguugcucucagcuaguacugaaaacgaacaguuccagauaagcagggcggcucuggcuucagcaagccgcagggucagcgugguuucaguucucuucuugguucuggcuguuucuugugggcucagcuguucuuuuaggugccuuguuuuauuuuguccagcaggaaguuuaagcauuuuggauaaaggauuuuuaaguuuucuggucaccccaaaaagcagaaccagaaaaaauucucuauaugugaagaguucaaauacauuuccaaccuuguagcugggauaaucagagaauuuacaaaauaaaaggauaaauguuuaacaaaugcacagaagggcaucaaacuuugaaucaaacaauuuaugagauaaaacaauuuaugucuauaaaauuauaaauauauuucagaagagagaacaaguuuggccaucaguguacuacaaaucucaaccauuagcauaacccacuaaaugaccaugucaaugaacuacuugaaaauaguuuauuuauaaauauuuacuuuccuaaucuaguaauguuuuaauuucauuagcuuuuuaguuaguaaacaaaauaauacauuuuauuauaaccuuuucacacauuaugucauucuacuaggcuuaugucugcccuccucacagcccuccugucccuugcccacugguccccuuuaccucuacaaagagucuccccucugucagcuaguauucauauuucuagaaguuuguucaagggaaauaauccaaaaugcagaugaucagcauguugcauguuccaaaaauguggucuuuaugagcaacuuaucuuuuaaucagggauauuuuauuucacuauaagucucagucauagacagacagacugccagaagucauguaaaggcuuuuuaaaaaauaugcuguccgggacuggagagauagauuagugguuaagaaaacuggcugaucuuccagagaaccuggguucaauccccagcacccacauggcggcucacagcugucuguaauuccagauucgggggauuugacacugacgcacaugaaaaaaaaaaaagauguuguuugagaauggucauagcacagcacaccugcucuaugucuagauucaccaaugcucgccucucugcagcagccacaguggaggaagagcuuggaaaaaccaaagugggacuagauauccccagcccuuauucucuggaggauuuggcucuugaagcccuuugcucuggcuagcacuuucccagcccccagacugggucaugggacucuacagagcccaucucacccaggagucugcuuauuguauuuccggugggugggugugcuguaugaacaugcuuguguggcuaugugugguaugugaggagaaugugcauauagaagccagagugucucccuuuauugcucuccauuguauuuucugaggcaggaccccucacugaaccuggaguucaccauucucaagacuagcuagccagcaagcuucgggaccuaccuauguccuuugucuauccugcccaugucugugugccuacacuccacaucagugacuucaggccaugcccagaaagccauccccaucuacucucuccuagaguaaaccaauccuuuccuucucuaaccuuuuacagccuguggcagugucuuucuccucccuggacacgacaacccucagcccagugccacaggcaacaaacucucaggacagaucugauuucaucugauggucccugcggccuuucugcugagcucagaguagaguaacuggugcuugucugcuuccuuuucuuguagcacuaggacuggggcuaugccauucagggcauaccaaaagugcucaaaaagcaucuuagaauggaugaaugagaccccuggguaaccgaugaucccauagagcauagcgagagacaggcucuuguucuauagcccaggcuggccucaaacuugcaguaagccuguuuuugccucccaggugcuaggauuccucuacaagauuccucuauaaugacaaucacuucauccgcaaaauucugguacauuaguuuacaggagauaugagccuuguacagaaauaauuacccgaaccuacaugcuaggguuuucuuggaauccacuuuccauuuguaucgagagcaguuuguuagggguccagaugcuuguggcuggggaaccuggcugccaagauccaaagcagacagcccugagcacauguacauggccuuuggacucuggcaagucucacugauauccccaggaagcuugcggaaccuccuguuuauaaaggguuucggucuguuauacuuucccuccuccuguucuugguaacacggauguuugcauuccgcaggaguuccuaaugugacaagcuguuugcuucuccagcuagcacucuccuggaccagacucacagcccuagcagcaucuggggagagauucugguccaacguacuaucauuuuccuccuggacugagcaagaaccucugagcuuaucuuuccugacuucagcuuugauacucugcaaacacacugugcucgaugaagucagaguaguacaaacauaaaguauggguguguccugugacaugcuucugaccgacucccuguucuacagggcaaaggcaugguuacuacuauggccuggacgguggucagccuugcgcugcaaccugugcuuccuccacaucuuacacauacugccuccuccuccuccuccuccuccuccuccuccucccccuccuccucuuccucuuccuccuuuuacuuuaaaacccugcagagaugaccucccaggagguauccauccuugauucccugagcaaacucagguggcccuucucugucuuacaccaauuugucuagaacuucuaaaacauuaagaaaagaaucacugaagcgugugucuugccacgcaucugcuguuugucacgggaauaucucacuuaguuuaggccuuuucugccccacugcccagacuccaacccugccccggacuguugcaauauucuuacaaauacacauacugcaucaucacuuccguggccuuugacaugcgcuuuuccugcggggaacaagggcacaggugcauggcgacagcugaaggcaaggauugguuuacucuaggagagaguagauggggaugacuuucugggcauggccugaagucacuaauguggggcguaggcacauagacaugggcaggauagacaaaggcccaagaccagagaacuucaaggccagagccaggggcaguuccucacaggacuucuauguagauuuauccuccagacaggaauccuguagaaugaaagugggcaccauuccauacuaugcugcgacucugagcacacccaagggcuucugcaagucagccucgcacuuuuauaugaacucccgcuucauauagaauguuuucugguucugcucuuuggggcgacuggaaaaaauuaaauauccuuugauuggaauacuuaaacacuucugccagacacaacggaauaagcagucucaugaguuugaggccagcguggacuagggaugccgaucugcuccaguuauauaaaugcugugcuacacuuacagugagccacuucaauggucauguuucccugacagaaugucuuggauccuucaugcuuucuagaauaaggcucaauguccuagcaugugauguccaaagggggaaauccgaggggcauggaaaucagaguaugcuuggcaucugccacuuugguuaauuaccaggaguugggaaacccuugguaccuuuuauguuucagauuccaggacgccauccucacuagagcagcugcuguaauggccccaugaguggcucugggcagagguggaggaguuucaaccagccagauauagccaccaagcuguccugaucccugagguccaagccaugggggaccuguccucacaaugaggacgggagccugguucuuaccagagggcccacagcugcgacuggaauucugauuugcaaguuucuuaaauuccaugagcucagcaugguccuucucauacguucucuucagauucuccacauacugcaucaucacuuccguggccuuugacaugcgcuuuuccugcggggaacaagggcacaggugcauggcgacagcugaagaaaagcaccaguuacucuacucugagcucagcagaaaggccgcagggaccgucagaugaaaucagaucuguccugagaguuuguugccuguggcacugggcugaggguugucguguccagggaggagaaagacacugccacaggcuguaaaagguuagagaaggaaaggauugguuuacucuaggagagaguagauggggauggcuuucugggcauggcuugaagucacugcuguggagcguaggcacacagacaugggcaggauagacaaaggcccaagaccagagaacuucaaggccagagccaggggcaguuccucacaggucuucuauguagauuuauccuccagacaggaauccuguagaaugaaagugggcaccauuccauacuacgcugggacucugagcacacccaagggcuucugcaagucagccucgcacuuuuauaugaacucccgcuucauauagaagaucaacaagcacucgggguugcugggaagaagcgcucuagggcugggucaugaggacuuaauguacuaggugagagucuuaacuuucugugcaggcaaagaggaauuccugaucauguuaaagugggggaugauggagucaugaacggagacagggcagaugugaaugagaccuguggagugagcgccacaggaagcaagugucucagcugguccaggggaagcagggaggagagcaagagcugagacacagacgauggggggggaccacaaggcaggguaggggacagaaggcaagguggaaggaccacguuacgaagguuacaagccagguaugguggugcaugucuggaucuuagcacucagguaguugaggcaagaggaacaugaguuugaggccagacuauacuacauaguuaaauucugccugaaaguaaauaaguaggggguuggagagauggcuuaguggcuaaaagcacuggcugcucuuccaggggacuuggguuuaguucccagcacccacauggcaguucauaacuguuuguaacuccagucacaggggaucugacacccuuuucugguuuuugauggcaccagguaugcauguggcacacaggugcaggcaaaauacucacagauauauaaaaacacauaaaaauuuaaaaacaaacaaguacaaauaaagaagagaagaguaaagacagauucuauaacauagagaacuagaaauauauuuggaaggguuacauacaauggagaugugggggggggguuccuuuuuccaugcucccuagaguccacagaggacgcagcuuaggcccugucuaucuuagagggauuucccuauaaauguccccaccaccaugugggacugaaacccgccucuucccuagcauccuucuggugguauuguuccccgaugagcuacuuccuaggucacaaugcugagucagccacccuuucuccagaaagacaccagggugggucagccccguggcuuggccgccuuucauuccacaggcagugcuuaugaguguacccucagcacauccacucacagaagcacugcgcaggaauggguaccgagacguuauggcacauuuaugugcuuuucaugaauuuugucagcccuacauggcagacacaaugagcagcucugguuuacagcccagcacacucacauguggagagcucugugagagccacagcaugaaugagggacagaaccuggaggggaacucuggcagugggcacugcagcauuguguggaggcuccauaugcuuucaaaguggccaagguggagagucugagcugggccggcaugcaacucugccagucacucacuaaugcuagaacaacuucagugucccugacccagaaugccuacugaaaauguuugggauuuugucagguuugggauuauuguauauaugcaauggaguaucuugggaauaguaccuaagucuaauuauguuccacauaugccuuauuguacaugugauccagagauaaguuuguacauuuuuaauggauuuugacugggucuugucacagaaaauuaguuguuuuuuaugugugccauaauggaggcucucaacacauuuggaauauuugagauuucccaccaucuagaagcuauaucuucugagaauauucaccuucacugggggggcagauacgggguauggaggccacuucacaggguuacuggguggauuaaaugaaacagugccuuuuccugaagugugcgcugcccaaugcugguucccuagaagcugagcacguguucugugagaacauugaaaagggagagccuccucagucacauauucuuacaaaacacacaggaaaaucucaacagacuucuccaguagggaauucucuaacuuaacuacuguagaugggcucuaaaagaggaaggcgguacacagucuaccucaaaugucaaugcccaaagaaaacaauuccugaaggaauaauucaaagguugaguuggcaccaaauauauuggaauaucucaacaaccuauauagaaugccuggucuaagucagucaccaagaggugauaccucucuguuaugguuuguauauucuuggcccagggaguggcacuauuagaaggugagacuuuguuggaauaggggugucacuauagguauggacuuuaaaacccucauacuagguuccuguaagccaguauucugcuagcagccuucagauaaagauguagaacucucagcuucuucuguaccaugcccaccucaaugauaauggacugaaccucugaaccuguuaucagccccauuaaauauuuuuauaagaguuggcuuggucauggugucuguucacagcaguaaaacccuaacuaagacacucuccuugcccuuguuugugucaugguacaaauugcuacaaguggaacaguaccauccagcaagaccaagcacuguggggcucaccuggcgaacagcacccaccacuucagcccgacuggagaggcgggcagccagacgaugcaagacggcgaugucuuccagaaguuucugauaggucucccgguguucgcagugguaccagauguuugcugaggacugagggacaacaaggagcaucacccagaguccucaaacugggagccuaaccccaaugugcagguuggggggugggcccucgggaagugacuaggucacuaggguggggcccuuaccaaugggauugcuucccauacaucaggggucacagaacuuucucuuacuuucuuucuacugugccaggcuauaaagagagguugucggucucauuauagacuuaguguggaccuaaccaugcugaaacccgaacuuggccuuggagcuaagagaaacaaguuuguuguuuaaaccaccagccuguguuaaugcauuauaguagcuugagcuaacuaagaaagcauaccaacccugaauucauuuucaugagacaagcccaggccacggugucuuccagauacaggagaagcccaguggagacacacuacaucuggcuggccugaaagaagucaugucugagccaaccaucgcucuccuaaggaucugccagggugccugaucccaggaccuuugccucagccccucccgauccuuugaggaagacucugccaggaccuuggaucccuucucauucccagagacuacuuugcuagugggagaagugggcccagcccuuagaggcaguugcucuucaauuaccguuauggaggcuuugaaguuuuccaguuccuucuccguguucucuucugucagguugcgcucccuuucagccugguuaauucuagacuccaagguguagcugucauuucuaaaggccaaggacaguuguacaaacacguucuguugggaacaagagugugguagaggugcuggaaggagugacugccgccagcaaggcugcgggugggauucuugcucaagcccuuuuaccaggaacuaguccccaaggcccccaugugcagguaaacuucccuugauggugaaacacaccaaaauggacaaauggcaauccuugagguccaggcaaggucuuucccaggaccaaauguaaccaggagacaauagcauucugccuuucccugaaucaagaacauccacguuuggguugagauaggccuuggccuaggccagagcuguguaagcaguuuggacucauacugggaccuauuucaggggguucgggaggucugcaucaaaccucuauaucugaagaauggccaacucagcagcaggcuuguggauuuaaagcaaacuuccauuucuaacccuguuaucucacaguucuaugucaccuuuaaguaacuucccagagauuagacaagaucagguauggaucaguuaugauaaauguccuggaauaaauauuccagcccgaaaugaagcacaccauacaggaaugacauauuuuuuaaaguuuuuguguguauggauguuuugccugcauguaugccugcacacgacaagugcagaagccagaagauggaguugaaucuccuggaacgggagccaccauguugguucugggaauggaguccagguccucuggaagagcagucagugcucuuaacgacugagccaucuccagccccgcaagaacgaacauuuuaaaggugcaggugaucagauguggaguuagcacucaccguaacacauaacuacuggggaggaaaaauagacaaguggacuccacaugagaaauaagaaggggggagguguuccaauugcuucaucugcccugccugaagcaagugggagcagcuuucuuucuuccuucaguguguguguaugugugugugugugugugugugugugugugugugugugugugugugugugugugugaacaguauguuuguacaggccagagaacagcguccaggaauugguucugucuacugugggggucauaauguugucagccuugcauaggacuuuuagucacuaagccgucucaccuccaugaucacugaccccugcccggcuucuggaguucaucuaacauggccaauggcaguuaucuccagacaagaacugccuccuagacgacaguggugggucuauugaaaauuaccccuuauugaccauggugauugugaauuauaaaccuuguuacauuuaacuccacaacgacucucuggagugaggacucuuacacccauuuuacaggugaagagaccaagacuagagacaucauuaacguguucaaggugacacaugaauaagcagagggaggacuuggccuuacaacaucugauucccaagucuguuuuacuucugccaugcugauggcugugugagcacauaccugagaacaggggcugacauuaaccgagcuggcaugaucagucuccauaaaugacaggccagugaugaggguucucucuccuaccuagcuuccgucuaugagcaguucucaaugcuuagcucuccauaccugacacgaaggguccugaggccaguuggaauauacacauccaacucaaucuuguuaaguccugagucugggagauugggugagcuguuuuauugcccagcuucucuucugcuuuaaguccugcucugccuacuuugcagagcuacugggagaucaccugauuaggggugggggcugugaacucgcugcagugguaacgucuaguucaagggcacuguguuaccugguggggguggggaacacuugucucagcuugucuaucuucccuugcucaucugcuccacuucuccaacccucccugacucaccucuacuacaugucuuguccaccugucccuucaccagaaugaaaauucucagcucgcccaucacccagcauugggacaaggagguuaaaucagggaagguagcaccaagagcuuucacauuguuggccaagcuguccuucuugcaacccaagcucucaggaggccaauaccuuuguccuccaugacaaacucugaagcuucaaacauggccacauuuaaaauuuuugaacuaaauuuaguguauuuguagagucuccuggcuagcuuuguauuggaaacucauccaucaagggacaacagcagucuuugaagauggcagcuccagcaaccuucucaccucucaccagauuugucaaaaugaauggagguaggcuuggggaacucagcaguggcugggaacaagcauucagaacaucccacagucauuguuaucacucuuguauagaaacguuagggccacaggcugcaggaaggaauguguggaugaaccucaucagagacagucagaacacgucacggagcccgugagccgcuuaccucaacuuccuuuucagugaguggaggggcgcuguaaagaagaaaaaaguacaggugaacuuuauccagccuacuaaauagcagaaggugacuucggaugaccagcaggucaugcacuuccagaagaggacugagcagagcuggugagaugaaaagauacaguccuuuguguccucccugucauccgugaccacugaccuuuauagaggggguguggaauauuagauguuggggucagcacccaagaacagccacuacaaccccucuaaguuccagcuugcucacauguaaaaucagaauauuguaugucuuauaggaauauauauauacauauauauguacauauacauguuugcacauacacauauauaugcaugaacaccuguguacuguguguguaaauacagucagccuuucucagccacauguuccauauuccuuuaagcaaccacuauauauugaaaauguuacaacaaacugugccuauacagaauuuauccagacuucuuuuggccauauucucuaagcaacacagaauagcaccuauuuaaauagaauuuacacuauauuggguauuauacaucauguagagauuauuaaaaaugucagaggguuguugagacuauaugaaaguacuaugccauuuuauacaaggucuugaacauuuggauuuugcuaucuguguggugugcauaugugugcauccuguaaccaaugcccacuguagguuagcuuuauauggcaccuuggcuauuauuacuguuuacccacagguugugagaaaucagaaaacaugcaugcauuugucauuuucaaacuaugucugacguaaacuguagcuuucaagggcuucccuagcucuguaaagacugauccuuccuuccuagacuccgaggacugcgacaaacauuuauuugguccagaaacaucuauuugguaagaaaaggguugguagagcucauugcaacaagagccuccaaacucuggaaucgggguggcauagaggugaccuucugagagguuccugagcaguucccacagcuugucccagucaacagauuccuuaucugcacaaccacuccauguggcugccugugcagcccuuaguaacuaaaguuggcuccauuggaagcccagauaacguaaauaccacacaggcgcuuuccugugcuggguggggaggccaggaggggguucaacucgcgucacaggacuuggcgacuaagcacaccaucaauaaacuucucaggaaacacaauuuuccucccuuguauggguacggagagacccugagagcaaagggagaggggucauccaucucugggaagggcugguucucacccuugaccaaggacagcaagagccuuccugucaggaugagacagcaagacccuguggccaucgagccggcagaaaacagaguauggggacaaacaaugacaaagaugucuccugcuuaaaauucuuuacacaggccuuguccucucagggucaacaugcuuucucacuugaaacggaagaggcacauauggucugggagguuuaucaagugcuuagaaugugcuucugucaccuagguucauuuggcuauuaaaugaaaauuacaucuuuccagaaauaauuagucaagcuuauuuuacauucuacuuugagcuacagaacacacacacacacaaacaguaagggacaggguggugugguggaggucaaguggucacgugacacagccaguucuuacuaagcaguaaggaggcagacucaucugggccuccaagacaaugcagaguaauggcgaaucuucucagguacccagugugcucucucucucuuugaaaucuaaauuuuaucaaaucacaagaauucuuuauagcaccaugcaccuuaccagguaaaugauccaugaauauuuccucccauucugugagucacuuuccgcuuucugggcaacauugaggcauaggcuuuuuacuaaaauuaugaugauggugaugacuuauuuuuuaccuguucuuuuaaaaccuucugugugugauuuccugucuuaucuggagcugugggcuaacccaaguucauagcucaugaagauugcuugucucuuguauuuuccucuaagcauuccaugacauuaaggucugugguccauuuugagcugguguucauguauuaugguagcuucauucgcuguucacuauauuuuguuuaugaguucucuauuugcaugcaugcauggaugacagaagagggcaucagaucccauugcaguugaugcugaaccaccauucgggugcugggaacugaacucagcaccucggaaagaacaaccacugcucuuauccucugaaccaucucuccagacccuagcuuugcucuuuugcaugugauucaccauuugucucccugauauuuauuaaaaccacuucuuuucguuuggaaagcuauucaccaaagucuuugcauguguggcuucuugucacugugaccuggauuccugacuacccugucauaaagaucuucuuugucucacuucccagugucucacuuagaucguucucuggguugcccuaucucauggugcuccuagaaacuucuccaaucccacucuuuacuuucuaauccagcuaucaaggaugcauucugggcugacacucucccaagcccugcccacagauggucucacuuagugcauccugccaguggcagaucacuuacgacucuucuacaggcaaugaagccaaaacucagaaaggaaaggaaccuucucccugugagcagaagucuggggcacuuucugcucaguucgucacaugauuuuggauuuugugcaucucuccauauaccgucugucccacagguaagugguuuauauggauugaaauguguguccccuggcaaguacuuugaaauguauguccucuggcccaaagcccaccacuuucaccucuggugacccuuguguccucaaagguucuugccugaauuucauauacucuuggaguuggaaauaccaacauggcccacccugugcuuuguauuuuggcugcauuagcucugccuggaccacuggacugcauccguuucagaaugaaaaccaaaacugauacucugcuguguuccacccauggucuaacauggggacccccugaaagaucuucaaaagcucauguccugauuuaccuuccagugagugacuugugaacccuaaguuugcgcagcaauaugucagaaauguugggcaucacauccagaccacucuuggacucuucuuccucagcugcuggggcgaguucaggugagacuccuggaaaauaagaguuuuccuuauagaaugccuguuucaaaucauacuaguacuauuggcaggucccacgagagcugucaacacucguaagcacguuguuacaugccagagaccuuauuaauuguuuucuauuuuacuuuacccucagaguggccugaagagcugcuucuuaaccaucccuuaaacagccugugcugccuccccaaaugaugcagggcuguaaccgggaaacggagagagcaggcuguaaaucucucuucugcuuguggauaguauaaggcucaauaaaguugguagcuugcugaagauuacaggcauagcaaauggcgcagcuugauggcaaaccaacaucuaucuggccccagucguuucuucccauaauccccagugucaaguaugaucgugugucagcauuuagauguugguuucuggcaacuggaagcugguugacucuuugauuauggguguuugggaaaaaaaccucucuauuugucaggcucuuaaagggaucucuugacugauaauuuuucccaaauaaauccaaaagcaccaucuccuagguccuaccuagaagucagcaucuuguuugccacuagauaguaacagaagcagguauuuuccaggauaaagcuaaggucaugagccccgucacaggucucagaaauacggaugucugcuagucaacagagccaacaaacagcaugugcugccuccccaaaugaugcaagguuguaaccaggaaauggagagagcaggcuguaaaucucucuucugcuugagcagcucuuuccuggaucugucgccuacuucccaguggcucuuugaggaauccuaugguucauggucucuagacccaucccaugccuauacauacucugccuuguugcuguuugagagaccccagauguucucuagcaaguguaacccagaccgcuggccaacaccuugggcacagaccuucacauccacacaagauagacuugcugugccuuaccguguucucacucacagcauauuuagggugaagcaacaaccucagacaucuuagacaucuuucauucgagccaccucaggaucccacugauccugaccagugagggugcugcauuuacacgcagcuaucuauccccauuuuuuacugucugccauggcuuuugaccuagcaguguuccaauuugcuugucuguuuuccagaauugcaggccaggcuagaggucagaacagaaggcagaguuguaccaaucaucuggcuggaauuaagacugggauuccuaucaccaagggagacaaagcagagaggagaagggacacaguuggguucacagugaauagguuuuuaacagauugacccuguucaauaacagaacaguauuauagacuccuugaugugucaguuauucaagugaaggcuacagggucaucugucauggacaggacagccaacacuacaucucuagguguaccauuagaccagaaguuccuguagcuaccugucagcucuugcuuucugcuggcauuuguugcucacugauagcuccaugugucaucugugaccuugcucuguaucuauacaccucugccacacuuagcagagagccagcuaagcggggggcuccugagguugcuguaugugugucugaaacaucaaaucuaauuccagaugaaggacacaccgggggcuucugccuaaaacauuucucuaaguugagagaaaaugaggggaaggaggaggaacaaaaauagaaaggagaaaagaaacuaauuagggcuaccagcucuuaucaaauagcaguuccauguauauguggauaccagaaccaaauacccuuucccugaaugcaacuaauuaacaaccaaaaaucauauuaucaauuauauaugugccaacaaugauuaaauacagaaaaauaaaguacugaaaauaauaauaauaauggcuaaaaacagaauuuccuagaaauaaaugggguacccccaccuuugauuccucuuucuuccucccuccaagaacagggguuuuauugaguuuguuugcuuugagucagggugccacuauauuguccaagccagccuuuagcuuguacugguccucuugucucagccucuugcauucugggauuacaagcaugcaucucaacaccuggccuaagaguggauucuggggguggagaguuggcucagugguuaagagcacuuguucuugcaaaggaacuggguucaauucucagcacccaugugggggcucaccaccuccucaagcaucaggugugcauguaguacacagacacacaugcagacaaaacacucauacaaacaaaauauuaaaaaaaaauaaauguugacaggaggugauggugcaugccuuuaauaccagcacucaggagggaucucugaguucaaugccagucuagucacagaaugaguucugggacagccagggcuacacugagaaacccugucuuuuuaaaaacaaaaauggauucuggauaaggaaguuucuaagaauauaagagcacagaacaagaaagaguagauagaaugaguaggcagccugcagaggaacgucagaaagaaaguuucucuagaaaguccuacacccuaccacaccaacacugccaagaagagaaagagaaagugcugccuguauuggcauuuagcuuucccugccaagaaggaggagagaagaaaggaggaaugaguauugguauuguaucagaauuaccuguauaauauguaggagcucaccagaagggaagauugaaaacaacuaaacaaauaaagcaagcucuucggauguagcaggagccguauggagagcuccaacuuaagcuccacacgaaccacguuagagaauagcacaguggcuaaaguccuugauuucgucuaccuuuucuuccuuugccuggcugaagaaugaauggcucuugguaaggggugggucaagucuagacaauaaacaucuggacagacucuugauacaauuccauccuaaacuggugcuccaaaucucacuaauccccagcuggaggaacagaaauaucucaauuugccauaauaaacuccaguuuuggacucugaacaaaguuauagaaaagaagcagaaagccuacaaaugcugcuguuaacagcuuugucugaacuuccucuuuccucccacucaagcagcaaagaaguacccaugagcacccaguccucaguacugagagaagaagacaaagagaucucagauguggcaggagggagugaaugaaaaccaacccuccucccccaacacauucaaggaaggaggagaucccgguggaaauguccagucacaaacagaugaaauggaaaccaaugacauggcagcuagacaaaaauacuagagugaaaagaggaaggaaagacggaagguagaaaggaaggaagaauggaaacacaggaggcagauguacggauggacacauagaugcagggaacauaggggaaaaagaaaaacugcauuucugugcaaaauauauacaguaacugcuuaacucuaggggaaauuagaaucugaaaaaaaugagaauaagaaaucaggacaagaaaagaagaucacacauaauggacaaggauucuauuuaaggaaaaaaauuaaagaccaagaauggaaugaauaagagauugaaaaaacagaacuggucagguuguuuuuuaaaaaugaggacauauaacacgcacaguuuuacaugaauuaguaagguggaccagauagauugaaugaucauaaagaauauaaagaggaaaagaaagauugaagaaggaagguucuaaguugaguucuaucgacccuuucauugaacaaauaauauauucaaagacauaauagaagaaaacuuguccuuaguggagggaagaguugaacuuggagguuaacuauacaucugaagcuuuucuuuccauucuuuuguuuuuccuucuuuuguuuucuuuuguuuuguuuucuuuucuuuucuucucaaggcaugucuauaaagaaaugcuacuguucuuauuccuaacaggaaagaaaauacacaugcagggaauauaaagguuaagggacacaguaaauaagaggucuuggguaucucuacaaugcugaaaacaauugggaaacauuucauagaaaugaauuagccaauaauguuauaguuaugcaggcuauugauaaauaagauguuuucaaauaugcuagaacucaggacacagaauacuuccagugcuucccaggaaaacuacuagauaaugaaguccaacuaaauaaaacauaaaucaaaauaaaaaugcuuaaggaugguuagccacaaggagggaacuggcaguaagcaugaaacccuuuuauucgggugcacaacuggacaacugugaaaacugguuacaaaguagaauggaaauguuauaaccuugaccacacacagaggagaauucaucagcuagccagucagaggcaagaaagcuggaagaaaucgcuagcaaagaaaauauauaaugagauguucugcuuuuucuguuuagggucuucaaucuuggaaagacugacucucuggggcuagcucauuacaggagacggggggggggggaacucuccuuuaaguacaccuuugacaucuaaaccaacccaaucaaccuagaaccuguauuuccaacccucuccuuuagccaucucucacauaccaaggcaauauccauucuugcuccacaucaucaaguauccaacaauuagacuccugucuccuuuucagagcccgcuaaaauuacucaaacuaucugacuccgagguuccuaagguaccuacucugcucagcucacuccuugucaugaaaaccccaguaaagauccuucccacccaccuucuaccuccuagcugacccuggugcuuuucuaucuggcccagaggguguacugugccccuguguuagggaaucugugaauauaaacuucucucaugacuauuauuucugugucuugccauaugugaccgacguuaugcuggguuaagaauuuagaacaauugcuccaaaucaaagccagaaaaauccacaacucuaaacccuuaauauauuuccuaauacauugucaaaacuaauuucuccucuguggaggaaguaauagcagagauucagcaaguccuacgguuucacuucacuucaacucaaacucaauuaaauuguuauguucuuaucuugaaggguacaucuagucuaaucucucuccuuccucccuauccucuucuguauuuguggaaagggggguauuuuagugcaacaaggagguuuuuaauuuccuccaaggccagagacaccaguuagaauacauuucuuugcgucugucuucucagguaagcauuuucccugugugagacaugagacuguggcccagccuugagcuguguagaaccauccaccuuccuuggaaaccugguccagacuuccaacgacccuguagacaucaccaacuagauacagagaauaagaaucauuccaacgccaccauucauaaaacaucagccacacauuccauacucuuucuuguuggcugucuacaguuguucggcugagucggggaaacggaagaccaguuagggcugauagauucccacagagccaaacucauccauaguagaaccaggauguaaaacugauucugucaaacuguugcaucucagcugugucccgugggcacucaauauguucaaauccagaugcuugguccucuucucaagggaguucucccuacugagaucugagaccugguacuagcaccauuacccacaaggccacccaugcagauuccuggugguuuucugaugccuuucucaccaugucccacucuccucaccuccaaauggcuuucaaacuauccuuccacaguccuguuaucccuugucccucaccagaccauuuccuuauuguuuuacaugggugucuauuuuacaaagggaugucuccaaugacagcauuuggaaugaggcauucucucaauggcagggccugggccuuuauaaauuuugacuaucuccuaucucaggccaguuguuguaaucucuucagaagaauugggcugggauguaguuuccuuuccuguaggcuucucuggcucaccaugugccuuaacuuauuacuuggcccuugaggucuucaccuucccccacccaauaccacugcuucagccucagggucacauagcccaucucccugggucacacauuacacaguggauucagcugaaauucuguuucugaagcaugccaggcaccagagaugugcuuuuguccccucugcuugcccugcccggugugccuuucucuuccagagcaaagcugcccccaaccuuccuugacucauccgcuaagcuagcugcuucuuccuccuuguucccaaggaccucugcucagucgaaguugcauuaugaugcauuacggugacucugucugcccuuggguuuccucucacagagaaugcaggugaguccauucauucaugaauuauuucccuaauuauugaguacuuacuaugucccaggcaagggggcuggagccaaagauagaugcucuacuaagcaaaacuuucacacaagugucccuuucagaaauuaguguuuaagaggacagagauuaaucagaggacaucuacaacaggaguucacugggcaaagaagagaggagaaaacccucuguguagaggggaaauugggaaauggaggaugaaggagcugcagaaggaaagguagauguugacagcugagagagggugguucugagugaugcugggaggugaaugggccuggccacagagccucggaggugauacugggaggugaugcugggaagugaguggggcuagccucagagccuuggaggugaugcugggaggugagugggccuggcccagagccucagaggugaugcggagaggugaguggggauggccacagagccuuggaaaugauacugggaggugaugcugggaggugagugggccuggcccagagccucagaggugaugcugggaggugagugggccuggcccagagccuuagaggugaugcugggaggugagugaggcuggcugcagagccucauaggugauucugggaggugagucgggcuggcccagagccucagaggugaugcugggaggugaauggggcugucccagagccuuauaggguuuuccaagguuccaguguucauccugagaacagaacgaagccucugagacaaaagugcacugcagagacucugggugcugugugagcugucaagaaugugggccaaaggucaaauugggagauggaugaaacguuaauggcuguugggacacagccaucuccuugaugguauggucugagcccuacucccuuaguccccaucacauuuccagaaaacaacuuggagaguggccuuuaucaaccucacaucuuugucuugaaacaaugaucaaaggcugcagaaugagcccugggaagggaacagguuggauuguugggaaggucagauuuauuggggaaacugagagccaagguucuggagacuccagaacacccugauaagggccuuuccugucuccccaaggaacagcaacaagauuagaguuuucucaugaaaucaucaucagagauucauuuuuuuuuuccugugagcucuguugaauuuagagcaguaguucucaaccuuccuaauguggcaacccuuuaauacaguuccucaugcuguggugacccccaaacauaauguuauuuucguuacuacuuuaauguuauuuucguugcuguaauuuugcuacgguuaugaauugugauguaaauauuuuugaagauagaggcuugcuaaagccacagguugagaaccgcugguuuagagccuggacauauucucugagucagagcuuggagggcugccggaucuuuuguucuggauacaugaugggaaggggccuguggaugacugcagcccaauccuguucugucacacuugguugccuagauagaguuccacaguucagcaacggucauugaaagaauggcaggaucuaauugaacuuaagacuagggucacacaaaacauuacaucagguuaaugaguacuuuaggugccauaauuauccccauuaaagagcuggguaaacugaggugccaagaccaagaaacuugcccaaagcucagcaaccaguaaaugaugaaacccaaauuauuaaucacccacaccuuagaccugagagaauaaggaggaaguguucauuuauugaacacccuggguucauuuuguuuaugaacguguguguguguguguguguguguguguuguucaugaguggaggaacccgcacauaccauagugauguguggaugucaaaugacaaccugagggaccaguccuugccuuccacuucacuugagacccuguguccugucugccacuguggaugccaggccuguuggccccugucuucaccccaucuaaccacagagguguugcgauuacagaugugugcugcagcguuggcuucccauggguucugagauccacagucuucaugcuugugcagcaagcacuucacccacugagucagcccuccuguauaauuccccuuuaacacugggagcucauaggagucagauucaccuaccuacucauaaaacucagugaccaucuaucaauauagagaggaagacuuugcuacaggcuagguauagcuauguuggcauaauuuuguagaaaaguuugacaaucuacacacaaccaaaaacacacauauaugaaaauacuguuuaaucuacccgucuuaccuguagaauggcaucccuuagaaaaugggcauuucuauaacaugugagagagugcaucauaccauuauuuauagcagagagacauguggggaaaugccuacauaucagcuuaguuuuuaucuuaaaaacuuaagguuccauagguauuaaaugggaagcugccuagguauauuguuaaauugagaagaugauaugacagggacauagcugacaacuacaaucuaucacaugaaugggguuugaacaugguguaaggcagcucuuaggcuagcaaccaugcuccuagcuucucuugcuauuugugaagcucgugccaccacagagcugaagugaaagaggaguuacaguccacacccugcucuggaaucugacacacacacccuccuauuaccuccacccuguccuguucuaagcugugggacuccaagaaucugcugaaagauaacaaaaggacaugagggucccuaggugccuggguggagcaaagccagccagcaccuaaauaacguacucuggaacuggaacugaagagcaaacgguaacacagugugucuggagucccugggucccaacaauuuaaauuuuaauuuuccuaaugcaaaaaaguugcagauacuccaaaacaaacacagguacagacuuggugacuguaaaaggaaauauaccaaauacccauaccaauaaauaaaagagagaagaaaauuacuaaauuaaucgaguaauauguacucuuuucaaaaaauauauuugauagacuucaagaccaauuuugaaacuugggaaauaaaaacauauaaaacauuuuuaauuauacaguaauuauaaauguauaauagaaauuuaaguauauauauaacuauaaauaaauauauaaugauaaaagguuaaauaauauuguguugguuaguuuugucaacuugacacaaauaagauacagcuaggaagaggaguugccucuaucagucuuucuuuuagacaucucuguggggcauuuucuugacuaauaauaggcuuacaaggguccagcccacugugguccugguugguauaagaaagcaagaugagcaagccagcaagcggcucuccuccaugguuccugccucugcuccuacuugaguuccugcccagaucuuccuccaugauggccugugaucaggacuuguaagccaaauaaacuguuucugcccacaauuugguuugauuaguguuuuaucacaguuaacagagagaccuaacuagacgauaacauguuuuauaauuacuacuuauauuuuauaucaaaucauauaaauauaauuuuaaauagugcauuuauuuaauacgaugcaugacucuuggaagaaaaagcaacacacuaaacuucacuccaaaagagaagcaaggcaaauguccuccucaccauuuuuggguuagauaaugguaccggagugauaaagcgcacacagauacagagaugcgcauggcuucccacaggcaggauaacugaaacgaugcugaaccagauaaaauaaaaguaacaggagguagaguuguaaauucagaaagagagauguucugccaagggggucaaaggucucagagguuacacacauucaggcucugauccugcuccugcgguuaagagauacaucaccacacaucaccaaggccuucacaagccucucugucuuugcgugucaugugacuaccgcagaccugcuugcuucucgugguucgugugagcacugagucuaccagggucaaacacucagcacggcaucuggcaugcaguagucacucuggcugcaguccuuaucccaguccccagagucagcacucuacugcuuaagaacaauauuuagaaugcaggaagcaugugacauggggccacacucaucuccacuacuagugauugauuggucaggaaauccagugaacuaagaguccugguuaccaauuaauaagguuacacagagugugcaaagaacacgaaaugcucugcaagagaaaacagaaauaccuaaaugugucuggucgagacaagaguaucugcaaggugaguaaauuaaagucuuacaaacuucacagcaaacaaaggauugcaugggcaauccuuuugaauccagcaugcaaggugcacaagaugguguaauucucaaaugugaaaggggcauacagaugucagaaaaccuaaaccucuguucacuucucuugagacagauuccugucuccuggccucuggccucucgcucauugcucauucugcaaucuugacuuaaaucuaugucaaauaugcacagauauguuucagaagaaaaguacugagagagggcuaaucccacuacacaugagaacauagucucauuaaagucaugacucaaaagaaacaucuuggccagaaugaaacagagccaagcuggguauggugggacauaucuauaacccuagcacucagaaggcugacacacaaggauugcuauuucuaggccaguucaggcuacagaaugagacuuugacucaaaaaacaaacaaacaaacaaacaaacaaacagaaacaaaacaacuaaacaacaacaaaaaaccacccccucccaaaaaaaaccccacuaaaauacuauaaaacaaaagaaaauaaaacaaacagaaucagaaacaacagcaaacagaacccugcucuccauaaauauauaugaauguaacauaugacugucacaaagaaauagaaacacuaucaaaauauuauuguaguaaugagcucuuaagucuuaauauaccuauaucuuaaaaugaagcacacagggccagguguggugguguaccagcaaucccagcacuugggagauaggaaguuagagcccuaugcauucauaaccagcuugcucuaaauagugaguuccaggcuacauggaaaacuccaugucaaaaacuaaaauacaacaaaaaagaugaaguucuuacuagcaagaugaagagauauuagcaaaauaaacacagauaaaucaaacuauaaauauguggagcacgguaugugcauacacccacacaucauguauacaugcauggucguacaugaacacauacacacauacacaccauguguacauguaccccuacacacacacacacacacacacacacacacacacauauauauauauauauauacacacacacaaucauguguacaugcaugacugugaaagaaaauacacaccauauguacauguaugcccaugaauguacacacacauacaaauaauaaacuaaaaaguuuaaaaauugggggcugcaugacacauagcaccagcuucuuucaggagauuuugaucuuucuugcuuuuuaacuacuguacauagcaggguuuguuguuaucacaaugucacaaauaaaauauguuguugcuuuguuaaaaauaauuggggucuggagagaugcucagcagcucagagcacuggcugcucuuggagaggaucuuggguuccauucuauaagaggcaaguauuucuacacucugacccagagacucccaugucugagaauguauccuaagggaauuacuuuaaaaaaaagaaaaagaaaaaaaagaaaaaccucacaagugcaaagacaaaacuguuuauaacagacggaaaacuauaaacaucuggaauauuuuacaauagagacagucauacaggaggaaauaugaacccacucagccauaaauaugauaucuaaauacauguaauuaguuauuaugacuucagugagacaaaucuuuaaaaggaaguugugucuauaccaucaaaccaacuuaggaaaugauaacuauuggaaagaaucaagcuauggauaagagcuuuucaaaaacauuuguuauuuuuauguguaugagaaguugucugcaucugcagcauaugggggucggcgcugcaggaggcuagaagagggucuuggcucccuggaaccagaauuacagauaguugugagcugccaugugggugcugggaugcacacccagguccucugcaagagcagcaagugcucuuaacugcugagccaccucuccaaccucaugaauauaaacucuuaggagguuuuucuaguguguuaauaaaacaauuaaaaguauuuauaaauguaugugauuuaugccucuguguauaugugugucugugugugugucugugugugugucugugugugugugucuguguaugugugugugccugugugugugucugugugugugucugugugugugugugucuguguaugugugucugugugugugucugugugugucuguguguguguaucugugugugugucugugugugugugucugugugugucugugugucugugugugucugugugugugugugugaguguguguguguguguguguguguguguguguguguauguacacagagggagaugucggcugcucuugcucugucauucauugaaggaucuggagauaggcuggcagccagcaaaccauagcaauccuccugucuccacuccucacagcucuggugcuacaggcaugcauugucgcuaugcauaugaccggcucuguaugugggugcuggggacucaaacuuagauccucaugcuuguagagcaagccuucuuacccccgagccaucuccccaucucuaaggugcuuuauuuauuuguuuguuugcuugcuuuuacuuaucgagacaaggucuagauacaucacccugacucucuguaacucaguauguaguuaaagccuggccucgaacucacagagagccuccugccucugcccccagagugcugguauuauaggcaugugccaccauacccagcuagagaugguuaauuuuuuaaaaauaauucaguccuuuaaaaaaggaccucugagccgggcguggcggcgcacgccuuuaaucccagcacucgggaggcagaggcaggcagauuucugaguucgaggccagccuggucuacaaagugaguuccaggacagccagggcuauaaagagaaacccugccucgaaaaacaaacaaacagacagacaggaccucugaaaccuuguuaacugagaagguggugguuauuguaugucagcccagaacagugauucauaagaugacaacaccagccauagacagugugggaggggagugugcccuuccagaggugcucugugaagccugacgcacacccgugcccacaggagaaagguggaaguuucagaaguuucaggacacuggcuuugcucucacugcccugccccccacaagccaaccuccucuggauuaguuuaucuaaaauuaaauaaugcuaaaacauguuucauaacugcuccugggauggcaaagccaugugauggaaucagcaguccuuugggccucaguuuccuuaacaauaaggugagagcagaagucccugccucuuaguuuccuggggggagacuaaaucugaguugccaaugacuuagagucugcaaaacacuagagaggauuuauugagaugacauuagaaggagacgguaaaauguuguauggcuuuguuuaaaugagggaccuagagaagacauaauccacagaaacaggaagugaaaugggagugcaaggggcugggggaggggcacagacagcugugccucauggguguggcugcaauugagggagaugaaaagggucuguggauggacgguggcgauggcugcacaauacagcaagacuggaccuaaggccacugccccacaugcugaaaaugauuaaaaugguaacauuagugccauauauauaguuacauauaacauuguacauaucaccacuuaaauuaauaaguaccaacaaaagacaagacauauaugcauauauauauucauaaauacaaaauaaggaaugagggugauuuuggagcagauggacagaccggcuccuuuaagagacaggugcaaugauucaacagaacacguagagacaagggagugagugcccacaggccugaggaagagggaagaacagagagccugcccuucuagaagcaucccuaaaagcauguucuuucuucucuggccaucacgaagcauucuggcuauugguugcuuuuaagcagcuaucucgguaucuccccugugcaccauuuguucaguuaaguauuuacucagggcuuaucagugccaggcagcacugugaauguaagcauauagcuuacaguauguacagacacacaugugcacacauggacauauccccagagagagauacgggcucuuggggcccaguagcaucucuggggaucuuaacggcuggcaccuagacagcacucacuaugcaccgggugcugcucuaggcauacuguaaauagaguuucauuuguguacucgucuugauaauguucgaggcaacuaugauagccccguguaacaaugugggauguggggaucaggcccggugaggccacagagcuuguucacucaguagcagagccaggauggacagcuguggcucaccccgggacaucagcgaacucagaggaaggacgcacgaaggcaggaacagggaggauccagccucugucuguauuuucagagaaguguggcagaguguguggccugggggagagcagaaggcuuggaggaagggauaugcagacacccagcagggcagggcuggauuauggacuuugugaugacagcagauugaaaagagagagcucuggugucuugaaaagaggaacugcucuauuuggguagcuuccuggguguaagggaaaagcaaugucaaaaguucaggccuggggcgccuuccagacccaaugccacuaacagggauagggcgggguggcaggaaggagacagacuugagcgugcucugccucaguggacuauacaaucuguuuccuucacacaugcacaaagacugaugggaaaucgaguguucacacauagaacgccaccggccuaaccagcccugggagggcacacagguccccccccaagccccucccccuccgccuaccuuuguccugcuccgcggccucacucaguucagggagcuugaaccccaccagguucugguuucucaucaggauguguuccuuggugagaggaagaaggaacacaguucaggugacgacacagggcgguauccugagguacuaagaacuuaggggacauuaagguccccuagauacgaaugcagcuguucuagaaguaauucuugauggucucacugcugggagcagccuccuacccugcccuucuguguaagugacaguccuuccucaaugaucuuuguggcaccuccagacaaaugaagccugagagucacugcuugggggacugagcaugcagagcaagguugggggugcuggaggacccaauaagcuacccuugcuccaagccaauccaugucagacuagggcccucucgggaugucugggugauauccugguuccuggugacauccaaggguucucagucucccaagucacuugagcgacuggccucugggcuaggggaaagaaaagggauaacaaagagugcccaggccauggcaacagaauucaggccaugcccucgauauauacuuggcaagccagagguccacagucccucagcuaccagcacacugggcaggguacagagcaggucucggugccacaccagcugguagcaugaacuuccagguucucugcgacuucccuugccgggagagagugagugaccugcagggauguggagaguucugagggaguggccuacucucccugccucuaaagucuaugaagcugaaucuccaguugucugcccccuuuguccucacuugccuccagggauaugagauguggaccacuuuagguggcucugcccagccuuguuuuaagcuaccagguaccuugggccuuguauuggagggugggaguucuguguaaauuguucaucuuucuaagccuccagcccagaacaucacagaagaccaagacuaucaucuaucuaucuaucuaucuaucuaucuaucuaucuaucuaucuaucuaucuaucuaucaucuaccuaucaucuauauaucaaguuauccucuaucuauauaucuauaugucaaucuaucaucuaucuaucucugacuggcuucaaauuuccaauauagcugaacaugacuuugaauuucugauccuccugccucuaccucucugguccuggaauuacaguuaccaccacacauuguuuuaugugacucugggaaccuaaggcuuugugcauguuaguagaacacuacugacugagccacuuccucucugaagcucucugaacagcccaguggccuguaacaauguguccuugcuaguagauacucucacuagauacucucauuggagcuggaguguuacugguccucacuuccuugcccuuacugccuuaauagaaaagccuggggacuuuguccuaucccaggcccuaaucccuagacccacagucuccuugaccuggauugagguuggccaccuaagaaagaagggacuggaucaggaccuucgauccaguuaagccccccucuauuuuacacccugaucucuccucuaccccuccacaucuggauauucucaaucacagacuauauagcagggcagcccccugccugaauaugauuccuaguuugaugacuaauggauguuggggacaccauggacacuugaagaaauucaccauagaggagcauccccaauggccauugucauaguggugcuugggucuaaggcccuugguuaacagguaccaagagggcaggauggaugacauuacaaagggaaagcccacuuauccugguuuugcccaauucuaggcaugaccagauaguccaucagaaguuccuucaccaggucuagcgggaggaggaagacagcuuaggauaaggaguccauguggcuaacuucucuugaacuguggucacuguauuucaggggacuucuauacauuaacaggagcaaaaggcacccgaagcuggugcuaugggguguaacacugaugggacuggcuucuaggggucaagaaguuugggauuucaugaggucagagcugucuugucccagggcccagcuugagugccaacgcccguagcucaggggguucuggcaugcauacacugauccucagggcaggaacccaccucccggagcuuggucagcuucugcaugcgcaccggcugcacuuguaucuggaagucuuugagcccagguggcuuggcuggcuuggcuuugccuggaaaccgcuucucuuccucugccaggggcagcuuagcgagcaccuucugcagcaggggaccggguucuucagggcugcugucccaggagaccccccgaaucagggggggccgggacacaggggaccucagcucagccuuggagccagccuugggucccauaggcucuccagcagagcccugccccagggaauguggggagaccguuccuccugagcccugggcugugguucugggcagaggguugccuucccgggcugucuucaggagcugccuccccagcuccaucucagcagggccaggcugggggcuguucagagccauuuucccacugaugcuugcuccagaagccugagccaugggcguggccuccacgugcugaaggggaucaaaguuuuccuuuuguucuacuguaaguuccuugguuuucuccacugugggagagcgaggagccagucugccuugagacacuuuucucuggucauucugcuucaggucagcuagcccuuuggagacauucugaaagaaacaagcuagaguucagacccggagguaggcugagaagacucagaccuuaacaacagccuauuuaugaguaugcaaaaggaccugucauaccucuuuaccccucagaguuccaucucauaagacagaggagucuucugcugacaccagaacccacccucuacucacauccagguccugcuaggcuucugagaccacauuccccacauucagugagcaaagcacaaacucacaggcucuccggggcaaggcgaggagaccccguccucaugucccuuuugcugaaaaaggagaaaaacacaaguugguaacaguaggaagaggccugcacccuucuugaagcuuagcacgguguaaaugccuccccucccccuaauccagggguuacagaggguccagacaugguagggauaagagauccaauggcagagaaauggcaugcccacguauuguuaccugugguggugcuccuggcagaggggacugagggccacugcauauguccaaaccugcaaugggccaggacagguaagugaugcucaucaccugccuagugcccugcuugucacuuuaacagcacacaaacaccuacacacacacacacacacacacacacauauacaccaacauacacacacacacaccccaacacacacacucacacacacacauacaacaacaacaacacacacacacaagaucuggcagccaaaaaaacugauguugcucacaugccagcacugaaacaccauagaaaccaaauaaggaaacugagucaugggggcccuggaggucugaugaccaggaagcaucugugaguguaggaucccgggcuuagcuuccagcacugacaaaggcagacuguggacuccauugccugaggguguggcucuggacacaacccagaaaggaagagaccgacauacauacugggcuuggagaugcagcucagugguugaguucugaccuagcguguguggaccuaaguucaaaucccagcacuacagaacagacaaaacucauagugguccaaacaaaaggauucaaaauaaaugugacgacuucucuccgagcaaaaagcagccauuagagucugcuucccaucaccuaaguccuauccucgcucagccuguccaucugcccucuccccgccaggaggggcggggucagccucaccuggugauguggagauggugagggagcagcuccuggaggaugcaggagaagccccagagcugagguuuggagaaacagcuauggaaaaaaaaaaaaccgccaauuggcuagcauucgugaagagcuaggacuucugcuaccaaauggaucguucucucagggagauuucaccccugggaaccgagacugccuugucaaggucaggggcugaucugaaccaccauauaagauucuuauuauaccccaacuuuugauacagccagaccagcagagggauccucaaguaauuucuaagacaugggaucacauuccuuaaccuggugggccuggccucagagaacuuuccagaaucugaggaccuggcauugcuugacaggaagagcaugccaggcuguacuuucuagaugccauagagcccgucugauuuccaacacucuccuuguccuccaaggccauuuagacuucuuuaaaaccugcuacauccuugcacucaggaagaagaaggaccacagcacaggauccuugucucuccuccagaguuccugggaccuuggauaccaagcccagggagcccaggauggccuucucagaucuuggcuggggagaugcccaccacagacagggucaucauaggaaggaugaggauguuagacagacucugucaugcgagauuaugcaagggucaguguguaugggaauugcacaggguuucucugcacuagagcuaaggacauagcaguucaauuaauaacaugagcaucguguggaauggcauuuguccacacauagggaagucccaaauggucgcgcauagggccugaaagcaaaacaugggagaguucucagggguagaguugaguagguguuuuagaacucuggaagcugagcacaaaggcuuccugaaggggucaucucugcaaggcuugggccauuuagaaccuggaggccaaggggacaggccaguugaagccugcccucuuggaaagaagguuguucugcagcugaagcuugguccuucccucccuccccucaguccagccuuagaggggcucaggguaacuaucuuccuacugcugguccuccccuaccugauggggagucuccgaggcugcuccuugauuuccucccacggcgggucaggaaccgcucacucaccaacuuggcuucuuccagaagugccagguuuuuuuucuuguccucuucugagaugcugauguccggcagcuggucauucaccaggucaaugacaugccccgaggggucugcagagugagaaugagcucccagugagagucaccucaucucagaggccucuuccagaaguagcucuucauuuucacgggguggggguggggggcucuggaucaccauuaagugauucagggggagcgagccauccccacucacaacucugcuucaggaagcaaggcugaguaguagugggucccaagccagcuuugaccgguugagcaaugccaucuaggcagccacagggaucagauagggaugaccacaugaggcuagugagaagaaguuuugggaaaugagagggaagaagggugucacagauaagacagaggcuuggaggugcagccgaccauuuguucccaugaauagaaggucuucccaagaagagagcucauauaugaaaugagaugagagauggaacaguacaauaacuaauaacccaaauuaaguaccuggacccagcaauaccugaaaccauugacccugaaggaagagcagacaaugauggaggaagacuaacagaaggcagaggugggggaagaauucuauuauuuuggaguaaguuauuaugaauuggggcuuuauaguuuucagugcucaugacacauacacacagcauagcaucugguugcuacaguacuguaggugguuccuacuucccaccaagucuccuuuuccaccaagagugccaucccucccuccugugugucugucucuuuaaggugaaacucaaauaccacuuccucuggaauaccuguacaucuuuucucuucccuagggagaagugggccccuucuuaccuuggcuuccuaagaucuuucaugaaggccauuuaucaauucuaucuacucauuucccaaccuccuuauaaaguguaaucaacaccgaauacaaagcccaagucuauguggcccgauccuucaguggucuaaaaaggugugaaaauccugaguagaaaccaucaggaauccuagccaacagccuuucacaugggcacacucccuccuggcugggcacacucccuccuggcugggcacacucccuggcugugcccauacagccguaggacucuggucuuugagcccagugcugaacaucacucagcugaucacugagcaucauuucugucugcucugacuucauccuccucuucuuucugacacugaaacuagacaucauuucuucugaacccaaacauggagaggcugaucuccucuauuauuuggacuuggggagagagaaaggagccaacucaugcuugcugcucaagcacauguucauauugacccagcccuuacccacagaagucagcgaagcaguggagaccuucaggugucggugggaaagccuccggugagggcugggagcccugaaagacagaccauggucauccuguuaggaaaucuacucagagauggacaaaugagaugacuguacagacucucagggucaccccagagcaucaucuauggcacacacaaggguccucugacugucaccuugggagcauguuagaugguugaauucccaggcuguaccccagucucccacaucagagccccugggaggacuaauggcucaacaagucacuacgccauucugcugcccacucaagcuauccaagcccacucucaagggauggaaccuuacuuacuacaggaguuacucucuauaaggacccggacuuuagagcuaucuugugggagccuuaccaaacauacauggggggucugguagagacacagauaaucuguuuuugaaagagaaaauaaaagcacaguuucacugcccugcaaaacacggagcuccuuuuaacgacguauuuuaauuauauaugugugugccugugugugcagaugcauauggaggcgagaggcaucagguucuccugggacuggaguuacaggugcuugggagucaccugauuuggguagugagaaccagucucagguccucugcaagagcagugugugcucuugacuacugagucaacucuccagccccaugaagcugccuuaugucugacuuaacccuuuuauuuggcuuuuuccacccccucucacauugauuaugcaaguauauucauuucuuauauccuccuugguauucacucugcucuuaauuaacagaugaagaugcucacucuguccuaugauaauuacccucuuacaugugguguugccugucaaccccaggccuuguugcacuugcuaggcaagcaccuucccacugaccuguauccccagccccgaggauuaucuuuuaaacuuauuaaaagugauaucuagacaaccuuauuccagcuagaucaauucacggaccccuggugaggggaacaggggcagugacaucccugugauggugaugcacugucccucccaaagguuccaugagggaccugcuuuggccacaacaggauccuauaguuaaagauccacaccuuccaggcuucugugggaauuccugggcugauauuauggaagguuuucaugcuaugaugucuuugauuuucuuaaaaucuagcaguguguacagggccaaauccaagaguaagaacaacauuuugggaaagaagauaauggugaaaaaauccuagguucucuuucccauuuugaaaaacugcuugauaauguggacuuuuauuuuugagauaaaguuucuuguaucccaggguggauuugaaccccucauauaaccaaggaugaccuugcacuucugauccucuugcuuccucaugauuucugggguuacaggugugcccccaccaugcccagguuaggugauacugagaaucaaacccaagaccuaacacaaacuuagcaagaaguacucuacaaacuaagccauauccccagcccucuuugacagcaucuucaucgauaaagugauucagagaaaaagaaagaagaaaguguuucuagaaaugcagcuauuugauccccacaaagcauugcucguccgccugggcugcauaccuguugacuagguuuuugucagucucuccuucaggugaacuggcaucccccgucaggacgauugugggagggcugggaaaugguccugcagagggagaguccuggugguuucgagcaaaacacaaauggaguuaggccugggcugaguuggggacaugcagggccuggaacugcggcauuuccaacagugugacucccaaggccauugucacaggucaccaacucuguauguugguuugucuguuucagcuucauuaagauauaacucagaaauggaaaucacauauauucaaagugugauauuugcugugaguguagagugugacauggcuacagaugaauuaaugaacauacugacuaacucaguuucccucucccucucccucucccucucugucucuccccaucccuccccgccuuucucccuacauguggggguaugugcugccaugugggugccaggaaucaaagccaugcucuuaacugcugagccaucuccccagccccuuguuuccugcuuuuggaacagcccuuuaaaccagcacuucuuagagcccgugguggagcuuuaacaaauucccagcauacauuggugcugaaaaagauuuuauuuuaauucauugacacucugacuacuuuccaaagcaaucaacaagaaccaagugcuuggcucccacucauuuucuuacaacugaguaauaagaaaucccagguucauguuucugcauaggaacugugguccaaaggauucuagccuggccuguuccacucauucaggccuauggacccaaacacuucugcuguggccucucaggugguucagccuggccugccuuacuggaguacaagacauugagcuuuggaaucucucugacucucuuguucuugcucacgugugacucuugccaugggaaggcugaaauucauuuuucuacccacaguucuaucacaguuuuuuaccaugccugugguggaguuuucacaaacucccagcaugcacuggugcugaaagggagacuuuauuuuaauucauugacacucugacuacuuuccaaaucaaucaacaagaaaauucagcuagagaaaccugaaagcauaaaaauucggagcugauggcugugagugccccuacgagauaaaaugagcacuuccucccucuaguggccuaugguuggcacuaggcuaagcuguuuguccucacacccuguggagcugugaccccucuaggacuggcuuugagaagugcuggcuuaaaggccuguuccagagcuucauucauuucaccucuccaaggacagaaaaagagaaugaaucuugagacuggacaccuguacacauaaaacuaaauuuuacagaaagagagaaaaaacugaguuaacuucuuucuccaccucuuguccucucuccuggccuuuacuucacacaucacacacucugaacauccacuuguguaccuuccugcccaagcccuccuuagccaucgcuuuaucucuccguguagccauucauacaucuauccaccaaugcaugcauuuauuugugucuguucucauccacccaucucuauggaucuacauaaaugcuuguguucguucaugucucuuccccugcccaccuauuuauccauaucccugucucucccucacauucauccaacccucucucuaaacaucuucuuuauccaucaguaaauucauccauaaacucuuucccuggauauccauugauuuauccauucauacaucucuuauccauuuaucugccuguucaucccuuucugucucccuaucuacucaccaauuaaccauccauuuauccauuaaucucucccauucugccugucuuagucaggguuucuauuccugcacaaagaucauggccaagaagcaaguuggggaggaaaggguuuauucggcuuacacuuccauacugcuguucaucaccaaaggaagucaggacuggaacucaagcaggccagggagcaggagcugaugcagaggccauggagggauguucuuuacuggcuugccuccccuggcuugcucagccugcucucuuauggaacccaagacuaccagcccagagauggucccacccacaaagggccuuucccccuugaucacuaauugagaaaaugccuuagaguuggaucucauggaggcauuuuccucaacugaagcuccuuucucugugauaaccccagcugugucaaguugacacaaaacuagccaguacaauugaccccuugucaacuugacacacaagcacaucacuaguaagccucaacccuuaauuucuuauucauccccaagaucuaaacaacuuuaaaagucccacagucuuuacauauuaaaagucaaucccuuuaaaauguccaauaucuucuaaaauccaaagucuuuuuacaauuaaaaaucucuuaacugugggcuccacuaaaauaguuucuuccuucaagagggaaaauaucagagcauagucacaaucaaaagcaaaagucaaucucuaaccauccaaugucugggauccaacucacaaucuucugggcuccuccaagggcuugggucacuucuccagccaugcccuuuguagcacacacgucauucucuaggcuccagaugccuggacuccacugcugcugcugcucuugguggucaucucaugguacuggcaucuccaaaacacugcaugaccccuucaguccugggccaucaauugcaacugaggcuggacuuucaccaauggccuuccauggccucucacagugccaagccucagcugcucugcucaacuccuucaugccuucaaaaccaguaccaccugcgugacccuuacacauuaccaaguccagccacagcacaagguacaacuuuggcuauaucuggaacacagccacugugcucucagaaaacacuucccagaagauuucaccucaaugaugcuggucucuucuuaaucaccgcuaauuucuuagcuccagcuaaccagcaucaauaguuccaguaaugcaguuuuugcuuugguaguucugguaucuuguuaaucacagcugauucuucagccccagcuaaccagaacuacagaaucuucacaaucaaaacagcaauggcccugaaaagagucuuuaauuuucccucugaaauuucacaagccaggccuccaucuucugcacuguuaucaacauuaucuuccaagcuccuacacaacaucccacagagcucuuaacaaugaauggaucuucaagaccaaaguuccaaaguccuuccacaguccuccccaaaacauggucagguugucucaggaauaccccacuaugcugguaccaauuugucuuagucaggguuucuauuccugcacaaagaucauggccaagaagcaaguuggggaggaaaggguuuauucggcuuacacuuccauacugcuguucaucaccaaaggaagucaggacuggaacucaagcaggccagggagcaggagcugaugcagaggccauggagggauguucuuuacuggcuugccuccccuggcuugcucagccugcucucuuauggaacccaagacuaccagcccagagauggucccacccacaaagggccuuucccccuugaucacuaauugagaaaaugccuuagaguuggaucucauggaggcauuuuccucaacugaagcuccuuucucugugauaaccccagcugugucaaguugacacaaaacuagccaguacacugcccauucaucuauuccucuauuucucuuucaucaauaaaucuagcaauccaucucucuuuacuucuuucucuacuauccauccauucauccauaugcugucccccaaucuaucaccauuuauuucucucucuccucccacaucuaucccccauacucccuguagcuccucuuagucauugucugcagacugucuuaaugccugcuuuaucucugacuugcaccaguuuacaaacaaguguugugaggaaagaccuuuucugagguaagagggcagcuaugcugggaguggcaagauucucuucgugcucaugaaguuugugagcacguacacaccccuacccgcuacucuauccauuuaugcagcaaacauuucuggaaugcccacugugggucuaugccuugacuggggagacacagaugauguaagcaaaucugagauacuuucugcuagcagaugggaugcagaggaagggguggaaggcccauucccuguaagccaacaucuauaagguuagcagccuucaagacacuggagggaacugcuuucuggcuggcauuuucucugccuucugggacuugcugggacuacaggcacccuuacuuagagagggcacagagcaggagugacuauccuggcaggcaaaaccaagccagaacugacaagugcuacacauauaaucaugaacacauacauacucucaagcugcucacaacccaaaaggauugaggucaacaggagaaaaucccucuaauauccugggagacauucuagaaagaucuucucucucucuccugucauuguauuuaaaauauaugucauaaaauagaaguguucuuucacuaauuggcuuacagaaugguugaacagacugggaacuuguagcuuucugccaagcuguauugucggaccacuccugaggaauacagacuguuuucuuuucuuuacucuagacuggaaacgaguguaggguacauugccagagggcacucaggagaaguuugucaagcuuuguguagugcaaauaccaacccuucucccacuugaagcuccuaagagaagggaaagauccugagagcuugauucuggcaauauguuauugaauacagaauacaggauuauauuauauagaauaugggcaaacuccuggcuuggggacuguaagagccuuagacucaagggucaccacauuggaccauaauuucuucuuaccagguaugugaccuuaaacaaguaaccuugugucuuggugucucgaucaccuuaucuagcuuacagaguuucuaugaaaauaaaacagguugaguggagcucuguuaagaguguuugccacucuuccagaggaccugaguucaguucccagaacuccugucuaaaaguuuacaacugccuguaacuucagcuccaaugaaucugaugccuuccuuuggccuccaaaagcacucugcacaaauacacacacacacacacacacacacacacacacacacacacacacacacuaaaugcuuaaaauuagacaaauugauauggaaauaguuuccaaauaaaauaaaagaucccuaguuauauuuaaauuucaaauuucaaaugcauagaggacagaucuugggauugugucccaauauugaauagaccuaacuaguuucauucacaaaaucuuagccccagauggaaaggccauggaaccacccuuggcacagagcaaggcucaguauuuccuucacagcugaguuuaucacuuuggaauuugauuucugggaaagugauauucuugaucuuggggcugguugacaauuuagagcuaaaucaggaguucauuaaggcaucagauuggcccuucugcuaacagagccaacaagcauaccaacccgccaucaccacccaggacauuuggucacaaaagcucugccagucaucuucaccuggcuccacuccucucucaccaacuucucaaacaagagauguuccaugugggucacagacacagaggaaaagaucaacuccucagaccucuugcaccuuagcauugucccaaacccucauguuuucucauucggcccaucaauuccacauguuacucagcagcacacuagggguaaugugaugguuugaauacaggagugccagggagugguacuauuuggagguguggcccuguuggaguagguauggccuugugggaguaggugugucacuguaggugugggcuauaagacccucauccuagcugccuggaagucaguauucugccagcagccuucagaugaagauguagaacucucaguucuuccugaaccaugccugccuggaugcugccauguucccacauugauaauaauggacagaaccucuaauguuguccuuauaagaguugccuuggucauggugucuguucacagcaguaaaacccuaacuaagacagguaguaauuccugcuauccucugauaagaaaacgagaagaugaaaaaucuguccauugaaaauauuacuuugccccagggccacaccagacaguggaagacacaccuucgcacugugccucgaugcuucuccauuugucacuuugccuuuguugagaccuccccugguuucugauguccuucagacaaucuucucuuagcucucuacacugcacacuucuucccgggggagggggcgaugggggggaugucucuuccuccaaggaacccugaauccaaaugagcagaacacacagcagggggaaagcaagcugggacagcauugcuuuggggcucuugucccucuuccuggucuguggacccagucuccccagggaucugucucucuuuucugggggugagccaagcucuguggggccgugccaccuccagcuagcucaccccggucauaagcagcaggucacacuucauuucccucuaauaaaucuuauagaaacauuuaaauguuuauuucacucauaaguucccaaggguacaugauaguuuccuaugcuccugagcacaagggauaaauauagaacgaugucauagaugggaauaugagcuucaaaucuucaauaucacaugacuaggucuggccuaggacucuuuaggaacagcuccaggucuagcccaggcaagugugaggagugugguggcuguaaugacuuugggugacagugagacagggaccccucugcagcccugugaacaggagaggagcuagauggaccuacaaugaagucucagcugggugacccccagggagguauuuuauuucucugaucuugguguuuaugaacaucaaauggggcuaauacuccccuagacuggcuuuaaaauaaacacagauaaagcaguaagaaugaugacagggcagagcugggaggaggaugcacaauguuugaccacauccgcagucuaucuguuauagccuggaaggcaggcagugacucucuugagaggggaauuugugcuccuaagacaaaauaaaaagauucucaggggacucacaaguaaaugaucauuccagugucaaauccugaggccaugggagagaggguaagggcuucuguggggcauguagcuccuccauguaaagcaggaggaacauuuuuugccccacaauccugaaggcuugcagccuaaccuaugugcucauucuggcucuaucagucucugucaguguccucucagcucccagagggcagagauccauagucaucagaucuuccugcucuccuuagccuuggucuuacucucgggcuaucacauguggaucaguacacaaagggaauugaccaugcuuugcaaaaugucacucagucagccagccagccagccucucauccugcaucaucuucuguccucccuucugggugcuauucccucuuccuccccucaaucuaaauauucagcuacccaaacuguaacacaaucauccauccaucuauccauccauccauccauccauccauccauccauccauucauccaggcaucuacccaggcauccauccaugcauuauccauccauauauccagucauccagccagaaucaaucuucauuccuuuuucccucucccucucccucucccgcccucccucucccuuuccgccccucccucuccccccucucccucucccucucccuccccuuccccccuccucuccuccucuugucccucucuuucuccuucccuuccuuccuuccuuccuuccuuccuuccuuccuuccuuccuaucuuccuucccuaagaucuuaccauacucuaggucugugcuaagaguagagauagaugugcaaaugaugcgaccccugaccccaggcugcucacauaccauuuaagaagagacagaaacagcagaagccacucuguugcucgcaaugggaacugaggaugagccaccauaauaugcauuccugacugugaucaccauuucugaaaugcauucuacuuuaauugaagcacuccuacagcuucucucuuugugcugugacaguugucuugacucuucuuucccaagccuccucuccaucuaacccuagaagaugagaggucaguacuggcucugcacaccugaggccacuggugcucaguccagugucuuuacuggcaagaggaggcaaagaagacauaugcaaggaaucuucauuuugaaucugcacuuaauuguggcauuugacuaacaucuuagguccagugccuucaucuauaauagacuggagaugauaauaucuagcuuggacccaugaauagcaggugccaacaacuguuaccauuaaguccuacaccagauccuaaugcuuuauuuaagcuucugugaagauauuucauuuuagaucuuaacugagaccaccuuaaaaggaugugaugaccuaaguggaugcuacaguucaaauauaaaaugccccucacugcucacagguugaagucuauguccccaguugaugguccuguuuugguggguauugcaaacuucaggggaguggagccuaacuagaggaagcuagguuagcucaccaauguccuagaagaaucuaccuugucaccacucuuuuccugucaagcuuuccacuuccuguccaucaugggauggguggccuugcuccaccacauucucccugcugugauguucucccucacucugagcccaggaauaacaggaacaagagaucauagguugaaacuucuaaaaccaugaaaugaagaagaauacuuucuaaguuggucucaggcauuuuaaucauagacacagaagacaaauuauggcagugaggcaucucaaggaagaugaugccgacaucccagguggguggcagaaguacuuccuuccaguucuaaagguggaucuguacaugacucaccugggugcucacagcuauaaaugaacaacaccugcccccugguauuguguagcuaccugugcugaggacauacaacagugcuggcuugaaggaaaaugggaugaggguucucacugggugauuguagaaguacaucucugcuccagaggguccuuacaagauuacaaggauuauauauaugcaucacuaauuuaaucucuacuucauucugacagaggauugguuauuuaagucuuguaagacuuaguauuaauugucaaucugacauaauugaggaucaucuggaaucaccugaaugugaggcccagguacucugcuaugcugcuuaccuauaagccuggaccagaaacauucuuggucuucuauggaacuuucuggcugcuuaggggguguuacuuugucaucucaucuuacaagaggccagaccagugugaugggcuaagagcuccaacugccugaggguaaggacuacauugaccccaacagagagaaagaacuucugaugauacuauggugaugcuuacuggggccucccauucugaucccaagaagaggagccugggggcuuuaagaccagaggaaacaaaucuccacgaagggauugccuccuuagagccuauaucagguacauuugucacuacuguuccaaaauucccaaacagagguaguuuaaagaaggaaggggugaccuugauucauggcuugggggugcagucugucacggcugagaagcaugguggcaggagugugugcugccuggucauacugcacggauugucagggagcagagagcggugggugcuggugcuccgcucaccuucuccucugauucauucugggagcccagccuaugggauggugcagccuacauucaagugcaugucccacaucaguuaaacucucuggaaacaccucacagauacacccagaagcauguuuccuaggggacucuaaaucccaacaagauaaugguuaagguugaccaucacagggccacacccagagaccugcuucuccagagccuaucucaccucaucucaauuauuuauaaacuggggacaggaaaggcagguaauaccccugauuagccgaucuucaaccacaagagcuucugugugacuggacaguaauggcuguugggaacaucaaaaccugaaguacacaacagaugccuugggagcacuggagugccucagagcuguggccuaggcugaguuuaguuuggcagaguguguuuuggggagccagagagccacauugugcuauuuuaucaucugacugaaggagaaugaagucagcaaauaucuucuuuuuuuuaaagauugauuuauuuuuauuuauaugaguauacugcagcugucuucaaacacacacuagaagugugcaucagaucccauuacagaugguugugagccaccaugugguugcugagauuugaacucgggaccucuggaagagcaguuagugcucuuaaccacugaucugucucuccagcccagcagauaccuugaaaagguuuuugaccugagcuugugucaguuguagagggaguuugguaagcccuucugccacaagcuacaguacacuaaaaguuaaaucuguuacuuuggaugcaagacauaaaguaaucaacccagaaugcccagaaaacccucuucugccuucgggcuuacauauugccagauggugcuaugcaggauacugggggagaaaaaacaccaaccaucuuacccaguaauguacccugcacacuacaauacuggccugccuggcaagauguguccacugauggaauagugguauaaugauuaugagggcaacaauccuuucugaucgaugugagcccugaccuccaggaugaauuucaugccuggugcuauaaaccugaucaaaaguccaugacuuagggagauggaucguagaucacagaauagaacuuacuguugucuuacuaaauggucauacucucuaacugccuucuaaauauguaugcuuaugcccauagauuugugcugcucucaauuuuacagagaagguucuuuucgcagcggguggugguuaacgcagagacucauaauuggucaaggugccgaguauaaguaacugugagugcucagcugucaaggggucaucuugucaaccucccaccauccaaggcucagggaacaucucagaagggggguggaguguaagaaucaguagguggaaagggaaacuauaaaaugcuaaccuuuagcaugacacgguuguugaauacaccaacgcacagcagcugugcuuaccugcacaagaccuucauaagaucaagccagucaaaauucccucaccuuuagcagaggaacuacugugagucaauagcuauggaggagucauucucuaucuggaaagcagcugcuagcaaguuagccacgccuucuugugcauauggaagaagcaucacuaagcagacucggguaauuauuaauaacaaaaggagacaagaaaugggagagagauagaugggcacuauggagaauuaaaggagggagugguggguggguaggaucaaaauacauuauauaaaugugggacguuuuccaaagaguaauuuuuuaaucuaaagcuaaauguaugaauacagcucaguaguuuccggugcccggaugccuguuaucaucaaguggcuuugugugcagggagguggaagacagagguggaguggugaaugcuggagcugacaacaggaagccagaugcucuguccaugaacucgagcaaccuguuccuagagacuuguagaaacccucaaaggagaaaagaacuuggacaaguggaacccaggcucuuacugacaggagcuccuauaccccaagugugccaagcaccucugaggaugcaugcugucccaaugagucagcuuccuaagugguuccuggucacagcucaggaaaguaccgaugacuuggucacacugcaucuggggucuguggcugcacagugaagaagaacaggucugcaugcauucuccaugcauucugcuccaggucccugcccgacuucccucaguaauguacugauacuuggaagugaaacauaaaaugaacccuuuccuccccaggcuacauuuuguugugauguuuaucacagcaacaaaaagcaaacuaagacauaggguuuuucuagcugacagccugucauucugugguccccaaagguccaagguaugugucccaacagcuucaauucagucagcacucuguguccuggccugggcccuagagaaugcauacugcugagucacugccagaaggcuucacuucacuguagggauagauuacgaauuccaauuagcaguugcagugaagagaacaauauagcucuccuacuucaaggguuuuguugugaagacucagcuagcacucaggcuaguggugggaaacagaggcuugggacuggaguauucaaaacuagggcuggaccccagggagcuauaaacuuggaaggaugcucuguuccuugccuguuuuacagagugggaauuuacacagaacgggaacuuccggcugaacccuggccagccuugcuuuccuggcugccugacuucuguacucuuggggagucagguuucuuucugccccuggaggcuccagcuagcuugggagagcugaaccuccccuguggccaugcuaccucaggagcccagugugagcagaggcucuuuaugaaccaugccuaucuggcuuccggagaacuaagagaggcccagagccugguagcaagaccagaaaguaaaagaaugaaagucucacguggaccuugaaccucugugcaaggguauaaauugccucagggcugagcugagcaggcugaacagaaguggcaacagcuaacccuuguucaaaguagcacacagguaaccacggggacucuaacaaucagaaaucuaacagccuugguucuaggucucuggaugaggaugcagaggagcuggaauucaaggccaauguggucagaccacagagaucgcagucuuaaacccuguucucugucuucucugagggaccugggccuccuggaucccauuuggcuugagucccucaagcauccuccuccagauuccggugcugucucagccauugcaacuugcaaaaaaacaaaaaaaaaacaaaaacaaaaaaaacaaaacaaaacaaaaaaaaaagucaggauagcuucagauuccuacaagcccagagacagaaucacagcaccugaaaagccuucagagaccauuagaacccaucucauuauucuuuaaauauuaguuuuggcuccaggucacagguaggcguagcuuguggggaacuggcuuucaggguuccuacuggccaaucaagggacuuaaccauugacucuacagcuagcacauggguuccucccaaugcuguaccucuaagaagcuucacccaggcccuggucuucauugagcuggaccaacaagcagguaacagccauggggguaacaaggggggguggcuuaauaagguuugaaaguacuuuaaaauauauuuacuuuuuuuuuaagugugugugugugugugugugugugugugugugugugugcaugaauguguaggccaaaagagggcaucagauaucuugaagcaggaguugcaggcaguucuggauggaugcuaggaacugaacucagguccucuauaagagcagcacccucucuuaaaugcugagagcuacagauguaggaagaauaggacuccuauucuucaucuagggaugaggcuguuucuuugcuaaucuuuuauuauacucaguuuaggagugcuuuuguuuguaggaggucaggggucucugugcuagagaggacagguacuagggaaaccuggaaugucaaacacacaggguuguuccuuugaaagaauggauguaugaccuguuaucugaacacaaggcugggagcagccuuugaguuauauguaugcccuagacaacacuagaaucucccuuagacccuuauugaaagcuuguuuuucuccaucuauaaacccauuuaauggauggugccacauguacuuuacaaagaguuucuguauagucacaucugaacuuuauuuagcuucauuugugcuuuauuguacacacaggguugaguuaucaucacuagggaaguuuucaccaaauugugcugugcuuaaauaugccuagaauaaacuacuacaagucagacucugaaguuugaaccaacauagcuacuuagucauguucaacuaaacuaccuucuuguugcccucagaugguuauucugguggccuugguggucaucaaaacccacauuuaacugggaaaauugccuaggauuuuggauccaggguuugcaugagaaugugaguuuggcgugguaccauuguuagugagggggccauaagggucagagauggccacuaucaaaagaacacagaaguggcaggguuaaagaaagccggauuggagcagccacauuugaaucugcucacagugucugccuucugcugugacccccuuucccuucccccaaacccccagcccucagcugccuugaggguugcuaaggaacagcauccacuauggcucaagaugccccaggaugguuguggagcuuucccuagaaccuggagcuauggucugcagauagagagaugggaguuuaacucuuuguuuuuuagaugaucaaggaaaagacacucccucaccccuaagcugccaaguucacaucuugagcucaugaaccuuggaauacaagugacuauucauuucuaaauaauugcuuuguccccaccauuuuaauauguaagaaaguaaacgccgucacaacagaaaaacauucaggaauggucaggaaucugcccaucuagaaaaauggcacucacucacacgcucuucucuugcuuagcaagccuguuucaucuggcucuggucagcgugggaccauggucagaggcaauaggauagcacaagcucagcgcaaaccaacucuaaaguucaagucaaaguaaauaauguuggugaccuucauaagcacagccuuuaaucugagaagaucagauggagcugggccagugaccagauaaagaaaauaugauagugauggaaagauagguucuucagaagggaaugacuucagcaucuugaggagauggguauagacuuacacuuuaaacauucucuugaugauguugcuauaaaacaagauguaaagaaugugggaucaugcaauugcauuguuugguuaacagaaaaaaaaugagcagaggcuggggaaaugguccaaucagaaagucucuauuguguaagcgugagaacuugagguuuuauccuuuagcacccacacaaaaaaggacagggguagcaugagaaacagucaggaagaccuuagggaauucuggccagccagucuuacuaaauugaugagcuacagguucagagagagacccugccucacaaaaauaaaguggagaccaguagaaagcauucaacaucaaccucuggcaugaguacacauguguacacuacauauacaaaacuaaaacaaaacaagugauauaccaacagcaaaaugcuugacucuucguucaaucugaaaauaaacauaaucuauacuuuaugauauauagagagagcuaaaaauuacuaaauaucauuugcaaaauaaagccucaacgauaccuucucugcuguuauuugucuggguuuuuuuguuuguuugcuugcuugcuugcuugcuugcuuuuguuuuguuuuguuuuguuuuguuuuguuuuguuuuugagauaggcuguagccuaggcuggucuggaauucaucaugaucugccaccucaguuuccugaaggcugggacugcaggccaccaugccugccucauuaaggguacucuuaaugaacauuuuaaaacucauuuuuauuuccuauccuuaacuaugaacuuuugguauucauuuuaagcagauuguuucaaagcagcccuuggcugucuccuacccuguauuuucuacaucuuucucaaguguacaagaaagcauuuugggccaaggugaucugacuucccauaaagccuuagucauuuacucucuagaugguuucacacucgggauuccugggacccuggccacuuagaugaacucaggguagcaaauucuucagagggaaagccacacaccuuccccaggcacccacugcagccuacacuagucacccacuguggccagucuguaagcuguggccucagacagaaugcuuaguuuggcccccacccaggcuagccaugggcaggaaggggcacuuacuugggucugggcugccuguggcucuccggggggcuccucauccucaggaauguggggcauggcagccgccugguuggaguggcugugcgugccuggaaccucugcugugccaaccccaaagaugcuccaagaggcuugggcuccgcaggcuggggagaugccaaaaggacaagucaaacuccuucccaucccugucccaaacuggguuccauuuccaggauccaagagccacagaugagcucuuugguuuugcaucaacaccagagaucaggcgaggagaggcgaggcgaggcugggagcaggcauugggaacugcacugccuccugcuuucuggcuuuguuuacaugggcagaggugaccuuuugcaucuaauuugguccuuacaguaaacacagcuauuccagaagagaaacauuucagcuccucaaaacuauagcuaagggaggacagcucgcugagaucagauaccaucuacugagcuccuacuggcagcaugacuaccauuaccaaguugacuccuugugauggccuuugauauggguaggcaucaauagucccauucuauaggugaaggaagagccucucagguuggaagccacuuguccugagucacauagaaaacuaauuguuucuaccuaggucuuccugauuggaggccuauaccacacagccuuuccuguggccugucuccuccccacguguagaaccaaggacagugccaauaacugaguaaccacugugucacagguccuaggugagugucacuacaugcuggagccuauaggaaaauccagaaagcucugcuguuucccaugacaugcuuucuguuccacagagagggccuggaauguuccccaaaccagagugcugcaauccagguugguaaaaggacacacagccguagcacacagaacccucugggccggacuuucugaggcaggaaaggugucugauucguuaugaauauucaaaauauccauuuaaaauggugguugcuuuguguuuaaagaauuggagacauuuaggccaguagcugucaaagauggcgccaucuuggcuuuugcauuuauucuaauagguacccagagcagaguugaagcauuuggggugaccccugcuggucaucuugaaaaucucaucucaacuaagguauucagguauucauucauauucucucucucucucucucucucucucucucucucucucucucucucuaguuuuagacagaguuugacauaacuuuaaaaauuugacauguuggcuucgaacucacguagcugaggcugacugauuccccuuucuccaucucccaagugcuaggauuccaggaauaugccgccgugccuggcugaaucauuccuucuuucuccacaaacaaacuuuuuauuaggucugugcccauguugugauggaaagagaguggguguguaguuuugggcccucacagcguucugaguccaguguuggguggcaacugaaaaacugauugguauaaacacuucaaaaugaggaguuauaagaacucaaacaagagucccuagcuaugcaggcugauugcaugagauguggucuuagggauggcucuauguuaugaggggaguuugagcugagccauaacacagaaauaagagcagaacuucucugguugcagaauagccucggggcugagcagaguagaugaacuggcagagaagaagccaugcuggacugggcuccaagcagacuaaaagcuguggggccaggaccacggugucuuccauccccaaaggcuacuggaugaaggaacugaacaucaaguuucccuaaaagaugaugaggucuuugaauaauuucaucaucuuuacuuagacaucggcauccggagugcugaaggacugcaugguaaugaggggaaucgagggaaacacguugcucgcuuucucaggucacgucacugccucauccccacaagucaaccuaucuuaauaggaacaguuuccaaaguaugggaggcagccauuccacuuccuguuuaggucuuaaucuacacagagcauacuguguacuaaggauucagucaagcaagaucauguucagaaaagagaaagaacauucuaugagggcaagaauuuguguuuaagagcucaagacuuuagcccaggacagagaagcugcaauggaaaagcaaucucuucuuagauaucuaaaagguagucauguggcccugaggucuccagagagcagguguauggccaggacucaagggccaagugagaaggcaaagggaccuucuaguagccagagccaguuaaagaugaaacagaacaaacuucaaggucaagaguuugcuguugcugggagacuuucgauauuggcuggcuucaggggucacaggaaugccaagcaccgccauggcuuuuuccuacucugaagccccagacuguaucuagacacaaccagccacaaggagcuccuagcccaggguccauuuagagacccuaggauuauaaaggucuaccagaaauaucccauucucuaacccccccccccuucccucucuugaagacagaccucugccauucccagaccagccagaaacaaaaugucaugaaugaggucagacacaccuggagaugcgggugaggcaggauggaggcuggcugcagccccacaggugaacaagauggagcugcugaggcucugugggaaucccugcagcccugcugcaggccauccccacgcugcucagguuccgugugcuuucccauccauuauuauaaacucacugcucaaaauagcaagguuaaaaacccagucaggcccccagggugacaucuggggggucugcgggggcuaacgggcauguggaccucauauccaucauagcacaguuuggaauacagccuccaggaagccaugaucuggagugccagcccauaaaaggagagaacacugagucaugcuugucucccugccucccuuucaauccacuuccaaauauuuccugaugcuucuccagccaggucagguuaugugagucaugccaagaaccaaucggcucuuuggagucuauucaucuggccucuuaccaauaguuaaacagaaccugcuccauuuuacagggaagaaaacugaggcauagaagggagaaacaaacaagacaggguucaguuaccuuuguaccuaagacaaacuacccaagagccucuguugggauaaccauccaaucauucguguaagugaagaggcuaagggucccuaaacuauccuuagauauuucauuugcuucaugaaaaaaagcaaaacaauauaccuuuagcauccauacaccaguuuccuuacugaguauccaacacuacuguguauggucacgugccauacuuaaccccuacaagacaggguguguguuuauuuaguuuuguuuuugugcaaugcugaaauugaacccaaggcccugaacaugccaagcaaacgccagccucacacucaugccccaggagcaggggcucaugaaccuuuccuggagcuguccuucucccgacugagcuaugccccagcccuucucuguaagcuuuauuacuuucaucuaauacaauaaagcacugaagcagggagacaaucaacaaggccguguagcugcuaagucugaguccaaaggcgccaucuucucucuuaccuaggagacagccaaaaagccuugugcaaggcuccccuccaggagggagaagugggguauaagcucccggaggcggggaggggaaguaacacuaagccuuugguugccaggccaagugucuucugaggguaaaguaagggguccagcuuugggagauggcuccauagguaaagugcuugccacacaagcaugaggaccugaguucaaaucuccagaguccacagagcacugggugugacagcaggcauccgugaucccauugcuucuaaggaaagauagggggagaagacaggaaaacucaagaggcugguaggccaccuugccugguguauggagcacaaacaagagauccugccacaaacaaggaagaagacuaaaccgucauuugagguuggccucuggccugcaaaugugagcuugcccacauguguacuugcucagagaagguccacagcuugaggcuucgugucccugguaugugguguaacgauguguucguucacugugcgaggaagaggcagcggcggcgcacucagccucacucacuucuuacucuucuagucacacaacuguccagagacuugucauugagccacucaugccaggaagccucacgccaagaucaaaagccugggcucugucccauaaagagcugccuuagaacccugcgggcugucaggggacaggcagugggggaaggcaggagggcucuggcaaugaaggccacacuuuauucuguucccagcagccaucgggacuucaguagauacaggaaauuuggcccaccugguaagucccauaccucauuaagcaccaggcuaucuucaauagucagggggagacaugaacagguuuuacagagauacccucagggcucucagccucccuggcagguggcaauggacguucugacacugguaacacaauuagucccauuugacagaugccagaggacugaaggcaucauccaugaauggcaguggcaggcaugccaguguauugccugacucugcagcucccugagggaccaagccugcuggccucucucagagccuugugacuugcccagaaaagaucaaaccccucacuugaagccacagugucccaggagcauggcgugcaugugcaugugugcucugaguagcucuguuccucuagaagaguugagagguccuuguggggagcaagggguuaagcaagccucaugaaccccucuggggugacucaggcuucucagaagggagggcucuguucuuccagcuugggauuuuugcuuucauuuagcacucaaagaaugugagugugauuagguugcuauuaauauccagccuagcuucucucuggacaaaaggcugaggcaggagacugcuugaaguaacugugcacacacaucucucucagccccucuacaaauucagagaggcaggagacugcuuuccauugccacuuuugcagauggggagccaaagcugaggugggagggcggauaugaccaaggccacaccuacggaaggucagugagccccugcugaggcuggcugaaggcagaagacaagcccgcgugagagcagagccucucauccuccuucuacucauggucucacucacagcagagaggauccucuuucuuguccucacccuggguggccucagaauguccucagucgacuaagaugauccugagguacugggcagaaucucuauggccuggccaacugcagagcuguguccuguacccugagugggcugggcauaucuccugcaugcuguaaaagaauccaagagcuccacagauacaguugcaagagcucagcagauacaguugcaacucuccuaguucuaccuagcugggucaguacaccuaggccucuguuuucucauuugcaaaaagaagguggccguguggagcuuuuaggauugguguaagaguuagagucguaaaugccugcgacaugcagacuuaacaugcuuucuggaacuuuccaugccugcucugaauagccaucugaguucucccagcugcaguuaccaaaaccugaccaaagagaagacuuuccaagagaaggcuuuccacagugacuggccacacgcacacuuggguugucuggacaaauggagacaugaaugaacacuuauaccaucugucugacaaugggcucccagacucuccccugaaaauauauuugaguuaaugagaagaaugggaguaaggauggcaucuccagcacacaugauuccuaagauauucccuugucugggacaucauucugggguccuguuuucucuggccacaccauccacuccuggggugucuguagugagccaguccugcucagaauaggccagaccacaccaggaaagucuggaaccagcauguuuguuggcuguguagggagugagagaauuccucaagacaggagugccacugaguuaucucccucagguuacucuuccucuugugugugucugugggguguaugugcguguggggaagggguguguagacauaugagagaguaggaaaaggaggagucuuggcucugucuugucagccucggacagaauggaaaaggaucuaaaaacaaaagauguaucacucgagguccaccagggcaacuuagugaaacccugucuugaaauuaaaaauacagaaguggauaaguuuggaggcagagcauuuggcuagcuugagaccugaguguugaucuucagucccauaaagagaaaacuuaagagcuaaauaagaaacuugaagcauuugcuucgguagcuagacacagcagggcagacuggugauuguauaaaggccguauaaaaaccacaaauaacuaacaaguagauuuaucaaugugugauacaaacuggaaacagucaagaaaagcagaaccauucacaguguggcuugggcaaauuuccuagguucucggaugcuuauucccugucauucucacagugaccucacauggcaacugcuuuccuuguggguuuugugauuaaaugugauuauacaaguaugggggaggggagaaaaagaaaaagggggagacaaacucaagaagaagcaacccaccuuccccaggaugauggggugaggggaagacagugacagugcugaggcuggggugucccagagggaccagcuccccaauucucuuggaaggugagcaguccauagucugaagucucgagccuguuucucagacagaacucuaaggaagagauucccaaagagguaugucaaaauagagcaugcucagggacauccucuggaggcugugacaucccaugauugggucagcccagucauuucagugcccagaccuguggcagccuugagaauaacucagugugucccugugauugcccauccauuuguuugcuacagccagcaaucgccuacaaaccaaggcacacuaucuguacaaggcacaccaucuguacaagggcacaccaucuguacaaggcacaccaucuguacaagucacaccaucuguacaagggcacaccaucuguacaagucacaccaucuguacaagggcacaccaucuguacaagacacaccaucuguacaagggcacaccaucuguacaagggcacaccaucuguacaagggcacagaugcauacccaucaggaguaaugccauguucucuccugcccugacacuuagaaaguccuugcugcaaaggcuccuggagcacagggaggcuugggacagcccugguuauccauguucuacauccuucagccucugaagaaugcucaggccagggccagaccucccugccccuccccacuuccccuccccaucaugacaggaaauaagccaaagcaucuccccagguuuccucuccagcuuguucacuucagcaguucuuuuuuuaaaaaaacaagucugcuugaaaacuuuuuuuuucuucuuggaaauaugugugauugcucaaucugaggcaguucaaaggcaccggcaauggcagcaaaguagcugaaccuccuauuuggcuccaagcagauauaaaucuuacccaguucccuuugugccuggcuguccagagacacauccccugucacucaugccagggugucaugagucaucacuggagucaaggacuacucagucugccaagcucugagagaccccauaaagaauagggcccccaagggaugcucagaauaaauggagggucaggaccgcucucaggcuccgggauuggcucugccuugcccagguggaugaaucugagaauuauuaagucuggcugaacuugaacccuaguccuuguguuuuagagaagcuucuguggugggguuuaggaacuggcccccuggcucacaagggccaacucuuagguuuucuagccuaaccuaacaggcaaguuccaaguuccgaagagagacccugucucaaaacaacaguuaucuaggaacaacacuugagguuggucuggccuccacacacacaugcucacccacauaugugcacgcacguacacacacacacacacacacacacaccaguacagauagacuacguuagcugaaacugaagggcgucacuccucggccacucucuuggagucuuguuaagucucacuaggaccugugcucuccagaggagaacggucacugacaggccacuguccaccucaucucugcugucauuagugacauccacuuagcaguaauaggcgcuucugcaaacagagcugagugccaccucuucucccagagugccagguguaguguuugcugcaugcucugaagcuaggcuagccuggcuuuuaucccuaucuggugcacacagaacacuaucacccuggcugugagccuuccaguugccuuuagacaaguccuccuggaaguaccacagaagcuauauguucugaccacagugucuaacaaauggcuacccuuggggaugcucacugcaucuuugauaaccuuugcacacaucuucuccccucugccugaacugcuuuugguccuuuggucccugaaaaucuccuauucguccuucagaacccaauucuaacacccccuccuucuaagccauuccucuucuuuaccauaggaaaagugguuccuuuccucuuuuuuuucacugcuguuacaaccaaucaccacuaauguggugauguaaaacaacaccaauuuauuaucuuacaaugcucauauugagagguaacuucccuuucuguucgcuaagaucuugguauugcggaugggcugggaaaacggcucaucaguuagcagugcuggcuacuuuucagagaaccuggguucaacucccagcacccacaaccaucuguaacuccaaauguagaucugacaccuucuucuggccucuguggacaucaggaauguaaggagagcacagacauacaugcaggcaaaacacccacacucacauaaaacaaaaauaucaacauuucagaauaaauaaauacaaucugaguguuagcagagcuguggucuuccaggaugcucaagggaaggaagccaucuccucaccucuagcugcuggggcugccuugagccaccaccuccuggggcaaccccuucuccuuguucccagccugcaaagaagcgggccucuucucugaccucugagcuuggccuccaugugugcauuuccgucucugucuuuguacucccuaaugcagggacucuagugacucugguguuauaucugucccugcaggugacccaggugaucuccccauuuguaauucccugcuugguuccaucugcaggaacccuuuuguauuucaggugacaugcucacagguuccacugugacuucucccagggagcuuugcauaggucucagcucuguuagaaucgaaaugccucaauagcaagaacuuauuucauucauacuuucaugaugaaugaauauucuuauaaauauucacuauaaagacauaaauauucauaucucaaugcuguccagugcagggacaaacacagaagaacgacucucuaaguguuuguugaaugaaucaacaacagccaaucuggaauacauagagaaggaggcuuugcuuuaguugagaagcagcuucugagaaaaugggguucaugaagagauagcacacacacacacaccuccuucuggggccaggcaagugagaugaaggcagggccuccucuguggauugauggagucuguggugacagagagugcaacugucacuuaaccagagcggcuacuauucaauuuuggggucaggaagaaauaucaucuuuuguuggcaagcacuuccaguuuccaagaaaagccaaaacucuagugcuaaaaauaaaaucaccugauuuagaaacguuaaagcuaauaccaaaaaaaaaaaaaaaauuauagaaauaccacaaggaccaaacaugugacucuggggacucagacugcagcuaccaguugccaccccugauuuaugcccucaaguauguuccucugggcuucacauacaaauuaaucuaauucauucucagcagcagugccagcaagagcacccucgggaaggccagggagcaaagcaaagcccaguccuuccaaaaggcuggcaguaccucaucagguacacacagaguucuguccccagggccguguggucccuggggcagcuccuccauguccgggccuagguaugguugccaaguauggcuucacuucuucauggcggcagggucuugcaucagggaaguaccucucaagccaaugaccauaugcccagaaacgucaucacuucacacacagcucagcagccauggcagucacacagcacagcacagcacagagagggugacagugaucuuagugggauauaaaccuggcucccuccuagcucugccuugaagcucagagauccugacagagaaugaacuucucaggcugugacuggaaaagaggacuuggccccuucuaccgacugccguagguaucaucgacgggaagcgcucaagaaaggguacaugcagacacuuccgugucucuuaacucaacuaaggacaacaccgacaaccuaagcccuccuuugugccgguuugaaccuaaaaguguccaccacagacuucuggguucagauacuuggccucuaaacuggcagugcuauuuuggaaggcuguggaccaguggagaccuguggcccagcuaaaggaaguggauugaucucuggagggugggccuugagguuuauggucccaucuggcuuccucucuugucucugcuuccugucccugcccucacacuccugccaccacagccugagcagcuacaccaccaugcuuccuacccccugacccccacccucacccccacccucaccuuccuccaccggacugucccugcaaaagaaaucauuucuuccucagguugcuucguaucaggcauuuggugacacugacaggaaaaacgguagcuaacacacuuuugcccggccuucugcccacauccuuucuuucucuuccucagcuuuauuucauuucagacucaccuauagacagugagaccugacccucagggccagcaugcaacucaccucugaggguuuccugggacgcugaaugacugaguggaggaaagaaagugucacacacuccacaaaacggauguucaaaguccugggucugaggcuaccuugggaucugugaccgccccccuugcccccucaggacuggcgaccccaucauggcuucuggaguuccccacacaagaaguggagaggaccuagcacuauguuacaucuuccgggagagauguugaacauguaccaguuggguugauguacauucugggguguggcuguuuucacuccauucccagacggcuuccccaggcuagcuucugaguuuuccauuucacccuuuugaaugugacaugccccuaugggcucacaugucugaacacuccucucccagcugguggugucauuuagaguguuagggagccuuuagggaggagaaacucacugaaguaagugggugucaggggcucccacuugcagguauaugggccagcccaacucccugcucacucuccacucucugagugugacacuaugugcccgcugccucagaguucugcucacccaucuaucugccuuucccaccaugauggacgguauccucaaagcuggaaaaaagaaaaaaaaauccuuccuccucaaauugcuucuuggcagguauuuguccgcagcgugaaaaagauaacuaauucaaccauguuuccuggguuuucugccacaugugcaugcaaauuuccccccagaggauuccaucauggcgcccucucaaagcacagagccuuuuccuuuucaguuccaggcucccaucauucuacccagggguucugugcaaacugacuuuuaggacaaacuuagcaauaggaccugcagcgggucucuaaucauccccacuggucucuccaguggcccugggagcuagccauggcacccaugagaauggggggggguguucucagaggaugcagaagcccaguguccacugcccuggcacuccugggaccuccuucucaacagagggcagccacagggugugcaagauggaaauaaccuugaaacccaagccccaauuccuuucuccacuauggagacagacuggcacuuguaaguccucucacuuggugccuggagucacucauuuccugugagguaggcccuugggaccacuugucucuuguuacagacagaggacuagacucaacauaccagugugccaacccaguucuggcugcacugcacacacagacccucagaagccagugugugcaucuggaucaaagccaacaacagcauguuuguggagcuuggacaucugcaccugaaaacaagcauuccuuaggauaggagagaggauggggagaaagggauuuuguccacauaagaucugaaaaaugucaacccagaaaaccaguagcaauagucuuucuucaaaacucuguaacagacuaaaacaaacuuucaacccaguaccucccaucacucuccccaacugcccaacucccagcaugcuucuccuuugcccccucccucuccuucuuuaccucccuucugaguuucauucuggaaaguacccacugggaucucuaugcaggaccugguuuggagaugcugucuaggaugggugucugaaucauccaucccucagcaaggcaugucaggugcaaccaucccaggcaccaagcauugacccagccccuggggcuucacagugagucuucgagggaugugcccucccagaagccuucccugaccucuccuggaugcucugucuucuuggccugaggaagcaccuguggguaccuccacuggccauccuguagcuucuguuuccugcacacguaugucauacccaguccaacccagggcagacagcucacuuucuggaagcuucugugggaauguggcacagguccagcaaucacucagcacccacagucucuuuuugaggcacguauucuuaugaccaaaucucauucucagauggcacauggauccugcaccgauagaggcuaugcaacaaggaacuguaucuccauuuuacaaaugaaaagaaccaaaccguaucauagaugcuagucacacaguccgaagacacaggauuaaaacugagucuccuagcccagcaugguggcucaugccuguaaucccggcguuuggaaggcagaagcagaaggaauaggaguuccaggcuagcccagguuacauagcaagaugucuuaaaaugaaacaaacaaaaaaauaagcuggagagauagcauaguagauagauguuuucaacacaggcaugugaugaccuguguuaaauacccagaacccagguuuuaaaaaaaagcgcuggccauggugaccaugcuucuaaucccagcgcuggaguggcagagacaggaggauggaucccagaggcucacuuggugagcuguagaccaaugaaagacuaggucccaacaauaaaacaaaacacaacaccuuuuguuguguuuuugguuuuugguuuguuuuuugauuuuuuuuguuuuguuuuguuuuuuguuuuuucgagacaggguuucucuuuauagcccuggcuguccuggaacucacucuguagaccaggcuggccucgaacucagaaauccaccugccucugccucccgagugcugggauuaaaggagugcgccaacaccuaaaguuaaucucuggcuuccauaugcacauauaccaugugagcacucgcauguguguucacuaauauaauauauaaaaauaauuaaaacuagcaaacaacaacgaaacacccaaaguugccauaccaggacuguucucugcaccauaaacagucggcaaugggaaauguuuccugacaaagucuugacuucucagguuccuaguccuaccucaagaugagcauugcaaaccaacaugcccuguggcaugcaguucucugagcuaaaagaucucaaaguacccaagaguggaaaagcagcagcugagaucagagauaaagagggagagccuuucccaagcaggucggacggagugucuccagcugaggcugccuucacccuggucaucuccaugcugagaaucucagagaccauagaaaugcuuggggaugggcugcaggacagggucagcucuaauauggcuucaggaggccaagaucagcuuuggacgagcccuuuggggaaugaccugccaugcagaaugacaccaucacuacuugggcuccagucuccccaucuuuacagcacaauguugaugcuucuagcugcacccccuuccugucucuugaguccaagcuucccauuucuuaugaagagcaaucaugagaugagaauccaggagacuagauaacaaccccgggacaggaggccaccccagggugggagguagccuguagaagucucuguaucacauccccugcucacagagauuggcuaaaggagacguacgacuagacagcagccaaggaaacacaguaagacuuugcugggcaugcugggagguuccacucuuaacuguuggcugauaguguaagagaguaagccagaauccuugccgagaugaugaacuuguuuagggauaaagucaauaugaaaaagugcacagcugagaguaaaaggaagucccuggggcuagccuccgacacccugaugagcugagguugcuaucucuggcuuuuccugcuuugagaaacaauacuuucuuuuucccucuaaugcuggcuuuuuuguuggcuuuuggguacugauaauaaugagcugcaccucaugcaaacagugugguuuuauaaagcgaggugcacagggccuucuauacaucacucuucccucgccucucugcucugccacucgccugagagcuccagcuggaaaagcagaucuauggccaauaggcuuguccugagcuucucucaugaccauguccaauccagaggagggaucaccuuauacaucccugccuaaaacagcaugacauguguugaagucucauaccguggacaagaaggaaccacagggcacuuuccucuggcugucuuugggagacuauuaacauuuaucagaacgugggcuucaccugacuuuacagccuuugucuuuccuagcucuaacaacaaucugcauuugcugaagcucagcaggaugacccagccuguuccaagcaccacgacuacuagguauguaccauaaacaggccccagcccgggguucuguucaguaucccauaaugaggcuucuggaacuguucagaagcuugcuucaucugcagcuugaagcucaacaauaaccaccacccaagccauugacaugggaccagaggcaguuaguucaucuggcuaagccuucagcaaugcaucauggaaaaggucuugucuuuaacgaccagauccacauuguuccaucugccacaccauuuguuauucuugcaagagcucaaccuaaguuaacuguuagguaaacaacaaggaguucaaucccagaguuaagcugagacauuuucauagaacauucccugacucuuauaaaagccugaguuacaagagcccugggcaggaaguggcagccagggauagaugggacaauccuucuguggcccugcagggagccauccuaagaaggaaaguuaggccaucagguccccuuuccaggaugagcccccaaagaccacagaccuggaaagucauugguauuggcaaguuuuaucaggucugcccaggcuuacaguccugggaacucccacaucucagggaacauuugcccuucucuagccuucugugcuauuuguucauggcauuuugaaucauuuaguugucaacauaaacgacacacuuccuagcucuugacuuuugacuuuggcucuuaaagauaaguauguaagaugaguauguaaauauaugaaaaucaaacauagagugccuaccacaaucuagcacaaagcagcuacugggaugguagcuuuugcuaucguuguucccauauuaacaagcacuccucuagcagagucaaagaaaguacucacuguguaucaaauauaaaugucccaauaagcaaggugcauugggauacugccacauucauuuauguaguuugguaguuuccccuccuacaaggacaguugaauaccucagacagacauuaucuaacucaaaaacaaacaaaacaaaacaaaacaaaacaaaacaaaacacaacaaaugcauuuacuaccuuuuuguggaaaaguuagucagcccuguuccaacauaguacaacgguuuguuuucagggugauguccucccuccacuuggcuagcaacaauuccaggguuguccuccccguguguucuuccaaauucaguguuucucgucugcauuucucugacccuuaaggugugauuagggcucagcaaauguacugaaagcaaaccuuuccaacacacuuuugagcacacacauccagagagucccuauggggagacggguggaguucuccugaggauugaggcugagggaauccgugacaagugagaaucuuaaaaggggcauuuguggaucaagcguucucaacagccucucccuucugcugacucagucuccguaucucacucuuucccacaaugaguucagcacccaugccuugccuagggacuacuuucccugguggacaguagaggaaacccuccuuuaggagauugccuugccaaaguuaaugacuaccuaccacccaagagggcaugcauggauggcuggcaugucacagugaccccucugguccugaccguggccaauuuggcuuauucacuuucaacaauggacuggccagugcuuguggucuccucugcauauugacauuguguuuagcuucagccacccaugugcucacauuuucuaagccaaccuugagggagauaacuagaauucuccaaagcaagaugaucaagcauugguuugcaagccagguguggaaucauacugccaccuuggccaacagccucccaccccaguucccaccccagcuucccacuccagccucccaccccagccucccaccccagccucccaggguuuggcuuuucagauuccauacaacagcuuuuagacuuucaacucccucaagugcuggccucuaucuccugaugacauaagccugacaacagacagcaugacagagacccugccccucccacacuccagcacugugaucacugucacggcccuggccaucaagugugacaacucucuccuguggcucuuucuuugggcuuaaggaacacaccguagcucuaaaacagaucauuagaagguuuuuaaaaaacaaacaaaacaaaacaaaacaagcccacugacacggagaacucugaacacgcagcucucccagaggucugaugggaagcuacacauggacaaaaaccaacauccacucuucauccaggcucagguagcccuccacuugcuccgaagcaaagccccuccucucuccucuagaucuccccauggaccuaauccugagcccgcagcaccgugaucaucaggggaauccuccugaaguuuguguuccccuuuacggacuggccugugagggauuuguaacugccugcuuccugaaagggcuagcggccagauaucaauaaaaauacccaaaggcucagagaguuaaaaguaacagcugacaaaggaagcaggggcaagcgagaccccugagcuacagaggauggcucugugccccaggggaaucuccaggcucagauggagcaggaucauugaaaguguuguagaacagagagcagcuaacaguuaaauaaccugaaauggacccugugcucuaacaggagcaaagcgggagggagauuucguaauucagaacuuuucaaguucaugcagagaaggacuccauuuacauauauguuguauuguauguuaucaugcucuuuacacaucaggauuugggauggccuuugcuuucuuuuuuauuuuuaauuuuuaaaguucauuauauauuaauuaucauuauuagaguggggaggggcuugugugugaagaucaaagguuaacuuugugggaucuguuaucucccauguuacacacuuugugggaucugcucucucccguguuacacacuuugugggaucugcucucucccguguuacacacuuugugggaucugcucucucccguguuacacacuuugccauguugcucaucugcugcuucuucuccuuuguuuucagggcuugggagguggcucaauagguaaacaggguuugcugugugaacaugaauaucugaguuggguaaagguguuggauaagugagcauuuaucuaaauguggaggcacacacauuuuguuguuguuguuguuaauuguuuguuuguuuaaaggcaugaucacaccuguaaccaaagcccugaaggcucuggagacaaguauguuacuggauuugcuggugagcaaagcaacagugagacccugucucaaaggaauaaaacugaaaguaacagaggaagaaacucaacacccucuucaggccuccaucuggccuccaccuggguguauggcaugcaggcuacacacacuauacacacacuauacaacacacacauggacgguuuuuuaaaaagguucauuuuauuuguguguguguguguguguguguuguuguuguuguuguuauuuguguguauguuguuguuguuguuuguguguauguguuguuguuguuuguguguguguguacccccaaaggccagaaaagaguguugaauuccuuggagcuguaguuauaggcaguuugagcugcccagugugggugcuggaaacagccaaauucugucugaucgcuugcaggaguagcaagcauucuuugccacugaacuaucuuuccugucccaaaauuuauauauauuuaagauuagauauguuuuuuaaaauuauuuuauuuguguggugaaugcauauguauuuuaaagauucgugugugugugugugugcgugagagagagagagagagagagagagagagagaucuuaaauaacaggcauuuaucuucuaacaucuuagggcuggaaguccaaaaucaaacucugucugguuuuguccuaaugaugucuccuggcuuacagguagcuuuguuucuacugugugguacuccauuucucaugugguauugggggauggagagggaaugaggagacaagggagagacucuacauaauaggaaaaauauuuucaaaagggauauuugaugggagacuaauauuuaggauaaagaauuauucuuucucaauaauuaaaaaaacacaauuuuaaaugggugaaauguuuaaauagucaucucucuagagaauauacacaaaugagcaauuaagacuuaaagccugagggauggcucagugcauaaaaugugcuugcuaugugagcgugaauaucugaguuuggaaucccaggacacacauuuuuaaaaagcacacauuuuggccaucugcaaaaacauuaaaaaucaaagaugcucaaccaccaaggaaacggaacucagcacagcaacacaacaucaacccacucagcaggagggaagccaugcccaguacuggaggccucgccaagugcuagugacgucauggaacuuggaggggagaaccuacagccaccaauucacuaaccaaacaucaucccuaccugcauuguacauguuuguccuuguacccacacucagugugguccucagcccucaucaagggagcuucucuuugcaacagucagagaccacuacaggaaaccacaaccaaucaaaauguagaguuauagagcccagucccaugguacaaaacaacuacaccuaaggcucuugggacauuguggaagaggggauggaaagguuauaagaaucagaggaacagggaguuugcugugggacugugucuccuagcaaugucagaagcuacacucuaaaguuucaccaacauagcugcccaaacauaaacaaggaugacaccaauauacgugccaaaguggagagggggaagaucacaaggccuuggcccuacaggcaacuaaagaaugcugagagugggaaaaagacuucuccagggaagaaaauaccuauuaguuaucaaauaccaaauggucagccauuaaaauauacacaucauagauguacaaguacauuacauggaauacgcagauuguauuuauguauuuagaaauguguguguguguguguguguguguguguguguguguaugaaugacaacaauuaaugaaaaaagaggucauggguuuaaaagacugaggaaggauauaugggaaauuuuggaaggagaaaagggaagagcgaaauagcguaaguauaaucuuaauuuaaaaacaauuuaaggaauacaauggcaguucaaagccauuauaguggcaaaaaucacagagccagauaacaaauuugaugaggauauaaaagaauuagaguacauauauuguuaauggaagcaguaaauagugagaacaccuuggcauuucuucuaaaaguuuaacagaaccacacugauccaccaguucuacuccuugaauuuacccaggagaaaagggaacauaugucuacacaaaacacacgcacaauguccacagcagccguuccugcaaucgcaaaaggguggacacacacuaugugcuccuuauguaaucaauggcugaacaaaaggugguguaacuguacaacagaauacugcucagucuagaacaaguacaugcuaggcuaugcaucugagccgaggugaggugggucaggggcuagagagauggcucaguaguuaagagcauaugcuguucuugcaaaggacccuuauuagauucccagcacccauaucugacagcuuacaaccaucgguaacugcaacucgagguagauccaaccccucuccuggccuccacagguccugcacucauguguacauaacucaucucacacauaugcauaacuaaaaauaauaaaaacaguagcuucgugugggacuccuaacggcagaaucagggcuaucucuggcucuguugccugccucugggacucacucccauuccugggcugccuuaucuagccuugauaggagaaggugcgccgugucuuacugaaacuugaaaugccagggcugguagauauacaugagaggccuccccuuuucugaagagcaagauaggaagaguagauggggggagcagagguaaggagguaugacugggaggagaugguggaggggaaacuguggccaacauguaaaguuaauuaaauaauuauuaaaaaauaacaaauaaaaagaugaaacauucaaagcauuaugcuaaaugaaagaaacccuucacaaaugacacacuguaagacuucauucauaugaaauuucagaauacaagguagauuguggcugcuuagggcagggggauaguagcaaugaggaguggcuguuaacgagaagagaguuucgugagguugaugaacucaauuguaauaaugacuacaugacccugauugcacugaaaaccaaauguagucacugaaucaaugaguuauauggugcauggauugcauuuuaauaaggcugagagagauuaugcaagcuggcccuacauuuuuaccucugugagaaguuuccucaaacaucaaagguauagacuggggucaaaguucagugagagugcuugccugccacaugcagauacugaguucacccccaacucugcagaaccaaaccaaggcauaaagacagacgacaucaggugacacgggaucuaaauccuuaaguguacauauguaagaaaaaugggcgagagaagagauggaguuugcuucuccgauggggucagcuuggacaaugugaagggaaagacacgaaagagccugaaagaaaaggaaaggagaagagacaggacuuaucaaagcuacugcaggcaggugaauacagguggggccagaacaaacugggaugccagucuagacaagaucacagguacauucgcaaacacacacacacacacacacacacacacacacacacacacacgcaugcacgaacucacucauacacaugaaugcacacacacacaugcacacacacaaacucaaacacacaaaugcacauacaugcacacauaacacacacucucacucacacacacacucacaugcacacacacaugcaugcacauacucauucacacaaauguacacacucccacacacaaaugcacacagacacacaugugugcacucacacacacaaaugcacacauaugugcacacacacucacucauacacacucauacauauguguauacacacacaucaguuucaaaauaggacuuuuggggcuggggaaggguauauaccacuucucaugggauaaacuuggaauucugucagcaaaggcauuuacaaagaugugcuuuaugagcacagcacaaacggggacugugucuugcaguucacuucuugaagucaaacagaagcaggauuuacuccacacuuagagauucccagaccuguuucguccucaucaguagggagagacuuagggaagcaggacugugagcuauuccaagcucaugaggccuccucugggauuucagcugagaacuucccagagaugcucugaccaccucccuguccacccgcuccuaguguguccaccacaaugaggacaucaucuguuacacugacacacacacacacacacacacacacacacacacacacacacacaccgcuuaaggcucuccugcugcugauggauaccugaagaaaaaaaaaagugaagcugagcgggaaggggagcugugaucuccacaguguuagcuuccucacaacucagcagagugaaggccagagaaguuucuggauguuuuuguucugaucucucccccuccccccuaaacuuuaggcuuagcuguccagugugccugaaauggccuuguuauuucccaagauggcagucuggagaagugaguguugaguguuuccaaugcuggguaugauagagaaacaggaagcagucuugggaggaaagggcauagacaagagccugcagauuccaagccugcuacaccaacgcuggguggagagcagcccucgagcuccuucagggcucccuaaauguccaccauuugaagcagcaguaaacuaaugugauucugucuccaaaaauaguccucagggcaucuaaaauugccuucgauccuuagcccggccagucccucaggaaugaugucgcuauuucuaaaacaucccuguuuucccagcaugccauugucagauccuaacuuccauccuggcugcccuaggcucuccugguucauuccccuuuugccuggucccucgcugcccuacauugaccgagcugccucccaauuaggaaauucucaaguugugccuuccacuuguuacugaacuggagaccuuuaaccuggcacguggcuuacgagagcagaaacacccaccugggaaacuccuaguacuuuggagguacagacaagaggaguucaaagccagccugggucacaaaaggagucugaggccagccugagcuccaugagacucuuaauaaaaaugauaaugaugaugauaguaauaauaacaguaauaaugacaguaaugaaauaaaauuuuaaaaauauauggucccuuggagaaguacugugggugauuuucugucucuuaauuccuaaggaugaagguucaagagugaaaucacauuccuacaggggcugaacuucucuuauucugggaguugggagauaucucuuugcuuucucuauauacagguuuaucuguucuggaaacauacaguaugugauuuugugucauuuugaagcuuaucuguguuguagcauuugucagaacuucaauucuuucuauagcugacuaauauuccauuguaaagcucucucauauuuuguuuauacauuuaucaguuauagacauguggguuauuucugccuguuagcuauuggaaauuguacuguuauaaauauuacuauacccacuuuuguuggaacaccuauuuucagauguuuuauguaaaugccuaaaaauggaacuuccaagucaugugacuuaaucucauugccucucauccucaccaacacaaguagucuuuguuuagaugacgucgagagaugagaggccacaguuccuuggugggauuucaucaugcucucccgguccuuaugccuguuuuaaucucuaucuuuguuuggaaccuuuccauugcucaaacaauuuccuaucuagugccgaacacaugcauacaauaacugcuaggcagauacuguuaggucuguccucuagguacagaagggacuuagcaagaccacauggccaugaagguucagccaagacuaauacuccaacccagcccuuuccacaccaccauagggcccucuguucaucugucccucugucaaaggccauuuuugaaauaacggccuuucuggagucaguucugaaauggaaucaccaugguuuagauacagcuccugcuggaugaugggucaggcccgggcaggcaccugugaacauugccacaaaacuaacauuuuuuuuaaucuuauuuugcaguacugaagauggaauaaggaucccuggacaugcuaggcaagugcucugccaccaaacuguauuccuggcacauuuucaacauuuuaauuuuaagcccacuaaguugcugaagcuguaccuggauucacaauucucagccucucugauagcuaaggucacauguuuacaccacuaggccuggagggcaucucguuucuaauaugccuuucuccugaggcagauucugcccaugcccuggagaauaaugaguaccuuuccuggguauuccauuacugucugaaauccuagcugugugguaucuucucaucgugccaccaaggugacccuaauguagcccacagcucagccaaagugcuauggauuuccuccuuggucuuuugcuggucacaggagugcccccucccuucucaaggagaaaucaguucuuggacuaaggaauccuagugaccuucaaaucaaaaugauagagccaugcuggccuguguccuggaggcuuccagcccuaauguuucacaucugcaugggaacaggagauaacaaaaaauaaaacaagcaagagaugacaggacacagugccaagcuucccuguucacaggcggccugccacaggccuggagacauccaugcuuccaaugagcagaugccauuucaaacaaggaagcugguaccaugaugcuuccagagucccaggugaugagagucuauggggagccacaagcccccgaagcccauuuccccuauucucacccaccaucugccuucgcuggugguucugcaggaaucuguagguauuuggugaucuaccccacacccauuuaagcauaaauaccagacuagccguuccugagcaugucuaagugaagguaagagcucugaaaagcaagagggcacaugaucggcuucggcucugcauggcauccccaauucuuagggcacaaacgcacaagauuaaucuccaaaaugguaugacagaacuuagugucuuccagccuuauuuggucaagccacuuuuucuaggccaaguguccccuauaaaacauaagucuagggugaccuacggccuuuuggauuagacagugucuguaagaauaaucacuuaggguuguaacuagaucugugucaucccugggcugagggcuggcuuccuauagagauggcuccagaacacuggugccucagaaggaaaccaggagcaguuacccagaagaggauuaacggccauuugucucacuugcuugucccugugggauggcauagaggaggagggugcacggugucauccaggugugcugacauuuacagggcuuugaaugcuggauacagauuccauaguggacuguguauggcuguguguaugcacaugugugcacguguauggacuguguguggcugugugugugcacaugugugcacguguauggacuguguguggcugugugugugcacaugugugcacguguauggacuguguguggcugugugugugcacaugugugcacguguauggacuguguguggcugugugugugcacaugugugcacguguauggacuguguguggcugugugugugcacaugugugcacguguauggacuguguguggcuguguguaugcacaugugugcacguguaugugaaguccagaggucaggaggaauucaccuugcuuuuuucuuuguuugagacauggucccuuggugggacuaaccaaguaggccuagguuggcuauccaaugagaccaaaggauugaccugucucccccugucuccccuccuggugcugguguuacaggcauauaccaccacauguagcuuuguguagguucuggaaauccaacuuagauccucauguucacaaagcaagcacuuuacugacugagccaucuccugagaaucuauacuggacuugcuaagguuuaagagaaacuguguguuuccugggauccagccacucucagugugucagaggacagauuuauagacuguggccagggccuggugaagguucagagugugaaguugugcaugugugucagcccucagaauucugcagcugucccucaauuccaggugaugcuggcacuacagucuccagauguauucaagguaaccagguaacauggacagcacuaacuucucuaucagauacagagggaccagggccaagaacccacaaaagugcuuggauuccaacaucauaaggaaaaaaauagacuuuuaggugaaagaauguuucaguagauaaguuuaucuucccaccagccuagaaaauaacacuuuaaguuuggguuuauuauuuagucucuuuagccgaggaugaccuuagccuccugaaccuuuuccucuugagagcugggcagaugugggccaucacucccuguuuuaugggauggaacacagggcucugugcauacuaagcaaauauucaaccaacugagccgcauuccuagccuguaaauauuuuccugaaggaggaagagauccaugaagacaaaguuccugagguccacaagaugcuaaugaggaccuggggacagagcagguggcagugaacuugguaaugccaccuaaucauggcuagaacugaacucuagagaauaccugaaaagccacacagguccagggucuauagucaucgagaggauauaggaaagcaucaaagccggugcugggugggugaguguuggcugcaagucuccugggccuuccugaguucaacaguucuccuccccuuugggaacuuugaaggugugcccaaggucugauggacuccucccaauucugaugucuacaagguccaucccuucccaggaacugaacuccagggccuaugagucuccugcucccaaagccagagaaccuggaacaacugaacccauagcaugaggaaaggaaccaggcuaucacagcucugcuaaggaugaaaacaagaccaucggcucugaucugagaggugaaugucuaaaccgaagcaugaaucaagugccuuguuaaccaaaugaugggaaacaggcauuccuccaacaguaaauguuuccuuaagcacagacugaugccagcccagcuguccccaggggcacugcagagccuuucagagagugagccauaacagcuggcucuuaaacacaccugcaaggccccuccuugucaccugcacaguaucugucacaauuauugcccugggauggccugaaucauacaacugucagguagauccuugcagaauaaacaguuuauggugaggaaucgagccccuggaaaaaacaagaguuuguccacgggcacagcaugagccaggcucaaaagcaggggucacccuuguauguuagcucccuuucuucucaggauauggcacaccaggaguggguauugaacaaccacaaccuucucugucuucaaaccugggaggcugggucuacucaugcucugccugccauggacccaugaaaacccugccacauuacuaccuuuccuuaucauuucuggaaacccacaaugagcaaaugagcaggcuuuuuguuguuguuuuuuguuguuguuguuggugguggugguguuguuuuguuuuuguuuuucgagacaggguuucucuguguagcccuggcuguccuggaacucacuuuguagaccagguuggccuugaacucagaaauccgccugccucugccucucaagugcugggauuaaaggcaaacaccaccauggggcugaguguuuugucagcauguaugcagguaccaccauauguauacagugcccauggagaccagaagaguguuugauucccuggaacuggaguuacaaaugguugugaguugccauuagaguccuggggugggggugagggggacacucaugcuuuuuccaagagcaacaaaugcucuuaaccccugagccuucucuccagcccccugggcuaaccuucaacaucuuacuaacucaaccuauacuucccuccugggcuggucaacacccaaaugugaauuccaccucccccugcucuugauauuuauuguauugcucuugcuuucucucucccucucugacagggucuuucuuuggaguugguuuggaaaucacuauguagcccagacuggccucaaacucauagagaucugccugccucugccucccaacugcugggauuagaauuuuuaucccucagccggcgugaugacgcacgucuuuaauuccagcacaagggaggcagagucaggcagauuucugaguuugaggccagccuggucacaaagugaguuccaggacagccaaggcuauacagagaaacccugucuugaaaaaaaaauuucuuuuucuaucccucaaugugcugggugcacuugguaaccaaggcaacgcagcguuggcacugauacuucccagcugugugauccuggcucaauuuucuuuaaaaggagggcgauagcacaaucaacuaccucacagagagcaaaaauaugaaaauauauagauaaugcaccagacacaguauuuagcugacacucaauaaaugcugguuuuauaguaaugauaauaacaagaauguugcuguuguuauuguuguuguuguaaucaucacacacacacaccgcaucacuauagacuucagcaaauggauucuuccucucugaacucugaaaaggugcuuugugugcauaaaugacuuuggugccuuccaaacuguagaaaugcugaucuagggacaaugugccaagcaucucugggucuaagacaugaaauccuugaaacccaacaacucccauaccuguuuuccucugcugggaccagcagaacuaggaaauaaucugcuccugagucaaggaaaguccuagacagccaaaccuguguuguauauguuggccauacagggccaagagcgaggaggaaaggcugcuguccaguggguaaggguaaaacucccauacaugaugaauaccauucucugugccugcaaugggccagaaaggccaccccacauuagaaaggccaccccaaguuaacaagucaaagcuucauuugaagacacuguugaggaacaguuccccuucuugaggaaaccuuccauauaaggccauguuucuccgccuuccuaaugcugcgacccuuuaauacuccucauguuauggugaccccaaccauaaaauuauuuucauugccuucauaacuguaauuuugcuacuguuauaaaucacaauguaaauaucugauaugcaagauaucugauauguaaacccuauaaaagggguguucaaccccccacauacacaaaggggucaggacucacagguugagaaccauugauaaaggaacauuguguuccuugaccacugacucucacugcugaucucacacugagccauucaagaucuuccuucugaaaacuuagagaccaggaaucacuggaaccugggcgggcugggucuguguccuagagcaauggcucucauuguacaguuggcccacccaugaaauaugagacaugcaggccuacaggucaggugcaugcagacaauccuaccauuugggugauuaggcaggagggucaugaauucaaguccagucuaggcaacauaacaagaucuugucuccaaaauaagcaaaacaaacaaacaaacaaacauacaagauagcccaacagaacauagggaaaaaaacuuggaaacuguuuucuauuuuuauuuuuaaaauagaaacaaaugaacuuucuuaauauuucauaacuauuucccagugauggcaucauguguccauauguugaaaggucacugucaugacuggcacaaugucuaucuuggugacaauuguucuucacugucaacuugauuggguucagaaacaccuaggccauuggugaggcacacccauggguauguugugaggacauuuccagagaaaugauccacuccaaauauaggcagcaccuaugaacuggguccuggacugaauacaagggagaaaggagaaagccaaccgaacaccagacucccccuuccuguguguacuuccugaucugcccagugagcaagcagcucacccugccagucucaaacugcugccguggccauguuuuccaacaugauggacucuauccucaaacugaggagcugaacucaaauccucacacuuuuaccugagcccuuucuucgggccuaaucaugaugauuuaaaagaggguuuuacaugugcaacgguuuagauaaauaccccauuuccucuucauagugaccuuuugagaaguccuacugauaaaauuauaggaugaggagggaaaagagagaggucaggccuuuugccuaaaggcacaaggcaacgucucugccucuguuaagccucuggcaacuucuguuuacuuugucagcaagagauguggcuaaggccugugugucccuccaaaagggaggccacucugggaacugcaucgccccagcacauacugcagucuguaagcagugugcaugcucaucccucacgggguugaguuacccaaacacuaccagcucuguuacccguuguuccaccagcuguuggcuaacugggucuuugcacaugacccugaucaguuuugccccgccuauucgucuauuuacuuaauauucuuucaaugagaaaugaaccaaggucaaaaucugggcucuaccacuuacuaaauucauguuguuggguaaguuccuuguccuucccucccugugccugaucuguaugcugaagaccacaauggcagcugccuggaaggguugccaugauagcuucaugagccaccucugugaagcacuggccaucauucagcacacagcaggcauucagugugugccagcaaccacuguugcauuuacuuaaaagggaaacuacguucuaucuaaagugauaagagucagcagcaguuaacacaaacagagagcuagaaacaccaucaaaacaaguuacuacacuccagcuacugcccaccaaagaugcugcaccaagaccuacccucguuuuaccaagaagagagacgaggaagugucagaaagcuguugacaucacaccgggcucaaaugagggugagcacuucccgaucugcacaggccugucccgguuuuagcaauucucauucccaaaaacuggucuucaaauauagaaucccuccuuggguacaaaagaccaagaggaccuagaaauaggucugugugauuccuguuaggugaagcuagccaguggcccacuagcagacaucaggccacacagcacauauccaccucugagaacugcaaacucggagcagcgaccauguuguguguauugcucagauaguccucucgggaagcccacauugcaaacaccaccaacaggaaggcugauuaaacguccacaacuaacaugacucugcacggugaauccauuucgaaaccauugugcuugaagaauaauuaacacuacagacaggagaucaccgugggaugugcaacuaagaaaaacucaggucuuagcuuuauaaaacuauagaacaauauaaagacucuacagggcuggguuauauauagcucaggugguaggcugcuugcuuaguguucauguuugucuucuguugcugagauaaaaccacaaacaaaagcaacauggggagagcauagccaaagcaggaacucaaggcaagaccuccauguagaaaccacagaguaauguugcuuacuggcuugcuuccuguggcuugcucagcugccuuucuuauagagcccaggcucacuuacuugggcccuuccacaucaaucaucaauuaagaaaaugcucccacagacauggccaugggccaaucuaauagaggcaauuucucaguugagauuccuucuucccagguagacuuagguuugugucaaguugacaaaaauaacuaugacucccugaccacacuaagcccuaaguuugauaagcuguaacacauguacugagaguuaaugguggguacagaggcauaagaucagaaauccacagucaucuucagcuaccuguugaguuugaggccagucugagcuaccuaagaccuggucucaaaagauagaaaagggcagagaggagaagggcagagagaagcguguagauguagcucucaaaacaugcccaaugacaccaucucaggagcuaagcagagucugcccuggucacuauuuacaugauaaaaguaugaauaggauaucuacuguaaugguggcaauacuuaucuccgaaugaugagauucugaagugcuucuucucuuuauaacuauuucugaauuuauuuuuauucccauuucuauauuucccccaagaaaguuuaguaggagcaaagacuacuuuuacuacuggugaauaacugaauaaaaauuauaaauaaaggaaaauaagaaguaaucagugcugauuaagaccaguuccuuuugcaguaacagcuuuaauuauauuauuaaguauaauuguuauugaaaagauauuuggcugaguuuaacauuguuuugacaauuucauacacaauacaucaugaucaaguucaccuucaacacucucccuuauucccacccccaauuccugcuccccucuucuccauuagucuucaucuucugugccguuuuaaauuuuuauuuauuuuuugacucacugaguuaacuaaggucgccucuguaagcauggguaaggggguuacuuccuagaguauaggcaacuuaaugucuacaccaaggaagaaaaugacaccagauuaccauuaacugccaacagucucagggaggggcggagcuucaugagccccccgcccccguccaugauggaauguagaaggguccaauccuaugcccaagcccagucuuagccaccucuuugcauuuguuacuggcagggggagcuuuucugccacuugcuuuuuauuuccccuagagaaaccccaggcagggaaggcaagguuugcuccaggucacaguccaaggucacaagcuggaguuaccucugcucaggugccagguucaaaggucuaucaugugagacagaccugaagccccaaauccacagugcuggugugauggcuacuuuuccucucuccuugauuucccauuuggauagcagcacuugguaacuccugggacuugaguuacuagcuacaggcagggugacaucgacugcagaaguugccugguccuagagagaagcagccugaacuggaacccaccacuaccagcagcaucugugugcuucuaauagagcauccugagucugaguuguaacauaaccacugacuugaagaacacauggggacgaggucugagcacacaguagcaacucaguuaccauccuuuucuccuccuuuccuuugcauuuacuauacucaauucuccaucucccucccugcucuggcucagcuccccaaggugcaagggcaguuauuaucucucuaccuggacccuuaaacagacugucaaaccacacugaagacggcugucuagcccaguggcccuguggggggcuacuugguugaaaacgcagggagagauauauagacaggaccucuacaugcagcaucuuuuaagccagacagcaagauucuggccagcagaagcaagcgcucaguaaacccgaguccuuuuaaccaagacaaaucuuagacguguuguaucuguucauucauccagaaaugaucgagucugaacacucaggagguucccagcaucauuuggggccugggacacacaguguggacucuguuuuuacagacuucaaucuucuggcuagaacccauucaucauguaaacaauacaguuuccuccacagacucccagaaugcuuuauccccaaacuaagagcccugggaccuacugggaacugggaaucauugguucuuaaucuaccuaagauacugggucacucuguggcacuaaacaccuucaagugucccaccuaaagggacagcuaaagcuguccuagcaaugcuguggggucaugugacacuucaugaugcccuggauguagcaugagggucuaugcuucuaccaccauccucucagaaacaggacccaacagaggugaauggagcaggggugugugugggaugggaggugucaagagcggaaccucuagagauggccaacugaggucacaucaguugugggacuucucuguggcucagcaaauacauuuauggacaaugucuuguucacguuguggcaauuggcacaguuuuccuucugagagggacauauaggguucauggaaaugacaugccaccacacauauggaagaagacauggucuugaacacagacagucaucuccaacacaugcacauacaugccgcugaauuaugaaccaaauauaacagagacaacugcauuaucacuuagcugaaaaucagaggccacuauuggaggugcucacaguugucagguggggacugguguaggcaugcuuucaaauccuagcucugacccuucuugugugacguaggcaaggugcugagaugaugaggaacugcacaugccccgcuaguguguaucaccucuuguugugagagagacucuuccucccaaggccugccucacuccugcucuagccuggcagcgcuagcagcuuucucccucuccgggcaaaauacagcucagccaaguucagggcugccuugcuuucuaugccacccgagagcugucugaagaguguuaaagagcagcagcugucacuuguggaggcaggagcgccagccagggguccuggggccaugcugcuguuuaugcagacuaugaggccucuccagcuuuuacaacuguuuacugugcaggaagcagcccagcagcugggcuuuuccugagccucgcucugcuacccucucuuugagaaagucggcccgagugccacucacucuaggaccucuggagaggugcaagcuaggauguaggcacacacacacacacucacacacacacacacacacacacacacacacacacacacacacacauauauauacagagagagagagagaucugugaaaggggacaugauguggugggacaggggacagauacaaaaagagagaugugaccagagcacaggucaggaagauaaagcauagaaauggacagagucaauggugaagauggcuggacaaacggguucacacgcaagacuugagagggaacaaaggagagacacgggaagccccagggaagaaaggccagccugucugcuuugcacagcaccgggcauuucucuacugucacaaaggauccugcaggagagccaggaguaaggggcuuagugagcagucacaucuuuaccccaaacugugcgugcuuuccaacagcaaguagaaggggcaggauuuagugaggaucgugaguuucacuucuuauuuaaaacuuaagacagcaacaauaaaaagacucggcuaaaauaucacccaaccaggccaccucccaugcaacuuaaaguuaagugcccccaucccagcgcccuguaccuuuaaggaggagaagacgccucucugcuucccuugggcugaagaggcagguuauucuaggcaauagcgaugacuuaccuaaa

SEQ ID NO: 12397 - RNA, 10440 nt, Mus musculus
caggcccuuguaacguucccagcgccgcguuugaauucggggaggagcggagcagagcaggacccucugcaccgacucagccagguucguggagcaacuucggcaucaugaaugcagcggccaaagcuggaaagcuggcucgagcaccagccgaccucgggaaaggugggguuccgggagaugcaguucccggugccccaguggccgccccgcuggcgaaagaaauuccggagguccuaguggacccacgcagccggcggcaguauguacgggggcgcuuucuggguaaaggaggcuucgccaaaugcuucgagaucucagacgcagacacaaaagagguguucgcaggcaagaucgugccuaagucuuugcugcucaagccccaccagaaggagaagaugucuauggagaucucaauucaccgcagccuagcacaccaacacgucguaggcuuccaugacuuuuuugaggacagcgacuuuguauuuguaguuuuggagcucugucgcaggagggugaguguuucagucgcagugcuggggcucccacaccuggaacuugcugacaaaggggcaccgagguuuuggagugaccuagaggagugguuggguuucaaacuuuuauggaaaggcuucuagcgaggguacuuggcacuccgaacugcugaggccgggguucuggggaaaccgagaccagauccuguugcuauuagggauggagcucccagacgcaaggcagcgagucgguacaggaaauggauucauaaaguggcuaaggaagggucccaggcuuggugugccacgcaccucuaacuuccggaguggggcagggucgggggagggggcggcuguuuggagucagauuuuagagcuuucaggaaagggagggaaucuccugccaggaggaagcccuggguaggggagucgagagugggguugagagaagacucaggagagggucuggugaaugauagugaccaaccaguguauggguagaacuaucagaaaccugcuaagacucuccacuccgagcgucuaguccuagccacauccagcuagccacucuucuuggacuucagugaccucuuucucccuccucagucccuccuggagcugcacaagaggaggaaggcacugaccgagccugaggcccgcuacuaccugcgacagauaguccugggcugccaguaccugcaccgcaaucaggucauucacagggaccucaagcugggcaaccucuuccugaacgaggaucuggaggugaaaauaggugaggugcugggccuucgggugucuggugucagggcaggaggggacaaggaggggaaggugaggaaauagagaugcugcccucuaguuaggaaguggaaaguguguguguguguguguguguguguguguguguuugugugugugugacacuuuccuugccuuuuuuuuagaugcauugguguuuaugccucaacucaguaguuuugaacuuggggccccucccccaaaugcuucucuauaaccuagcacugagccagacccucagccaauuucaggucuggacuuacgcuguagaguauggcaggcagcaucuccucaggugucucuuuacuaagcugaaaaaccugcccccuugagucugauuggccagucccuagaucccugucacuucuccacacacuugcccagcagcagucacgaagaucaucuacuugauuccccagugcaucuaauucugcuauccugugcauuuuaaauuucauuuacuuaugaauggagacaggcuaacuucaaggagucaguucuuucuuuccacugugugggucccaggaucgacguagaucauguuaucagucuuggcagcaagccccuuuaccuccugagccaccuuaaccaccguaacccugcuaucuaaagaggugugugggaggcuggcuagggccaguacaguggaaggguucagggacucuggggccucaagccacuaguucucaaugcucaggaucaaaacagagcugccugcaaccacagacagcccgggcuuagcagcugagcacccucucuucuuuccucugucccaggggauuuuggcuuggcaaccaaaguggaauaugaaggggaacgaaagaagaccuuguguggcacuccuaacuacauagcuccugaggugcugagcaagaagggacacaguuuugagguggaugugugguccauugggugcaucauguaaguuggcaauggccuuggcuccugggccucagcagggcuuucugaggcuucucacccaguugacuuugccaugugaaucuuucuaccuuauagaaaggcuguuuuaguggacaggcugucccacaugaaacccugcuuuucauauaucagucuggcguaggcuguuggauuccuguaacuugacuuguugguccagggaagggaucaaaaagucccugaacuuuuccuccuggcccuuggugcuuacuaaaaguaugcacagauccaaaccaucaacaccugagagcuuguuaggaauucagaauuucagaucugaaccuggguuuaauacaaucccugccugacuuuccauggagcauuggaaguccugcugagugcugaagggagaacuaggccaguagaaagccuggcgauaggcagaaccaccacgguggccugugguggauagcaguggccucuggggcacugggagaguccucggucacuguaggccagagccgucaauuccuggccccuugguacacagguguugucacuugcauccuucugagggcuugucccagccuuugguugcugugucacuggacugacuuggagagcauccccguccguucccagucaguaaguccagcacagcucccuuccuuccuacgguccccagacgaugacuucugcauuuggauuucccuuggaguuugaacaacaacaacaacaacaaaucccuucuuguacccccagguauaccuugcuagugggcaagccucccuuugagaccucgugccuaaaagagaccuaccuccggaucaagaaaaaugaauacaguauucccaaggugaagaccacacuuccuguuuucauuuauauuccagccaaaagcuauuuacugagcccauccuggggacagagaugagucaguccuacuucuaguauagccacggagaaugguguaugucugaugcuggcccacacugcauguugaguuugcacaccagauucuccugcucugccucccaagagcugagauuacaggcaugugccacuaugcuggcuuuaugguguacuggcaagcacucuaccagagccccacgcccagcccacgucuuuaggcuccuccugaaagggauguaaagcgcagggagaaaaggagggaacagggucagacacacuuacgccuggaacacgaaccaucuccauccagcugcgcucugccuaacaaaggaaguggccuuacgcucauguagcaggcuucccaucugcaaaguaggaguuuccccaagggcuucccaauaacaaaacaacagcaucccuuuucacauccaguggcauaaauccauucgaagggauggcucauuucugaggacuagguucacauggggaaagucaguguccuuggcuuggacauagaguagauaugucccagaaggucagcccaucgccgcagacaaccuggacugcuguggugugguccuggcuuuauuagugaggccaugcauauucucagauggggcacuccuguuucccaucuacaagugaggccugauaguggagaugcacacaccuguaguccuagcacuuggaaggcugagauaggaggaucgcaaguuccaggauagccuuagccauauagugagacccugccuccuuucaaauuauguagagagggaaaaggagaagagaauccuuuagauguuuuugugagggccaaaggaguuacuguacagaaauaaauguuacguggaguuaaguuaaugcugugacugacagccuagguuucaucucauuaagacauccugguggggauguugccuuuccccauuuaauaggucugccuugguaggccccggaaagcccggguuacuuguuauagguggaaucaagagguugaaguaguauuuaagcacagcucuuggaacuuggaugcccuucuugguggugguuguuuguuuguuuguuugagaugggaucuuacuguguaggccuggcacucaauauguaaacugagcuggccuugaacucacagagagauccaucugccccugccuuacaaaugcugggauuaaaagcuugaaccaccaugccaggcuugcacauaauaacugaauguacuuugaaagggcgagccgggggguggggguggggggguggggugggggggugggggaggggggggugggggggguggauuaucccagguuaaucuugaguggcaaguggcaagaaauaauccuucucaucaggauugcuaaagcuggcuagaggaugacuugauggagcucagggccacugagcuaugauauguuacagacaggaacagcugccugggguccuugccucaucucacuucagcucugccucuccauuccagcacaucaacccaguggccgccucccucauccagaagaugcuucagacagaccccacugcccgccccaccauucacgaguugcucaaugacgaguucuucacuucuggcuacauccccgcccgucucccuauuaccugccucaccaucccaccaagguuuucaaucgcucccagcagccuggaccccagcagcaggaaaccucucaaaguccucaauaaagguaaagaucggacuggggagaagagagcccagguuuucaggguacauuucagggugcaugugccuuacugcauagucagguccuaucuuugagucugguccgcgggcccuuugcccuguggccuuggcaggaagaacugacugaaucaacccauuggguggguccaagaaggaaaaaaugaacugaauaccaagcccaggaaauuccaguuaaagaguauagaucccucuugcaugguuuguggagaaagcugaaaguuuucugguacauacauggagcaagccaugguacuuguccuugguccucacgguccucacucgcagcacuuguguuuuguuuuucaagagaaguauuucugucaccuaggcugcucuuaaaaucaguccuccugccuagggcccugcugaguacagguuugcaucagcaccucccgcuuuggaaaagucacuacagcaacuccaggagucugcccuuuuacucuugcaguaaaguauacgucuuuuuccaaacuuuaccaucccuugccccugcuuagauaacuuuuguuucuggagcucuuuagagaucagagcuucucugauucauguguuaauaugucuucaccauuguccacacuuaugaaaagguagagaggggugaauguccucccaguucacucacacucuguugaugccuugaacucagaaguccaccugccucugccucccaagugcuugagagagcaaaggugugagccacuugccuggcagcaguaucugcuuuucuguuuucuacugucacucccuccuuccccucucuccucucucucucccccccucucucucuuucuuuugagacagacuaucaccacacagacucagguuugaaaucccccugccucaccauccacagugcugggcuuacaggacugugccacugcauuuaucaucaucaucaucaagucuuuuuuuuuuuuuuuuuuugguuuuucgagacaggauuucucuguguagcccugguuguccuggaacucacucuguagaccaggcuggccucaaacucagaaauccgccugccucugccucccaagugcugggauuaaaggcgugcgccagcacacccggccaucaucaagucuuauuuguccuuaauauauuucauuaagagcugugucuuugaggauagcuuguucucuguguggauuuaguauaaaacuaguauucaguauaaaauucucaguucaucuguuucaguuagauuuccauuuuuaggcaaguggcuugggauggcuuaguuucguuuuuggugcuuugagacagggucuuguguuguccagguuaacccugaguuccucccaagugcugggauuucagacugagugcuucacuucaccccugacucaaugacuugguuuauuuuggaauaacuguagugcuauacaaaauuuuuuaaaacaauaaaguugaauuccuguguacccuucacccagcugcuuccacggucagcaucucccuuaaaagcauagcauaauugccaaaacugaaguguuagcuagaagauaaucccccuaaucgaucaaccagauagauccccauuagacccccagaaugcaagucagcaccucacauggcaguuagcgaccuuggcuccuuaguuuccuccagccuguggcagucucuggguuugccuuaugucuugugaccuugacacguuuagagggugcugaugaguugauauccuauuggauuugaugcuuccucgggagugcagugagguucugcauucugagcaagaaugcuguggagggcuuugcccuucucagugugucagggagaccgugucucucccacagacauuguuuccuugguaguuaauaaauagcuugcaggaaguuguuugaaacuguagggaccaccagucuucgugguagcaauuauuacuguaauuucaauuuuguuucccuuuuugagaccaugucucauguggcccgaacugcuugggucucacaguagccaaggacaacuuugaaccugugcuccuucugccucuauauccugagugcuaggcuaacagucagggaugggcuaccaugccuaguucaugagcaguggggaaucuaagucauguuggacguguauguacggaggguagcucccuguccuuccccgcagugcuggaccuggggauuccuaacuuccucggcgguggagguuagaaugccgcugucuuauaaguauaguaaagaaacuguucuguagacagccuccacacucacccaaaggcagggaaccaccugcauuaucugucccuggggcauucauuucuccuucauuuccaauagcuaaauuuagacaggcuugcuuuuuacauacucuagucuauaaacacucauuuuugcuagguuuuauuuuuuaacuguguaugggugucaugcauguauguauguaugugcaccagguacaugugugauaaccacagaggccagaagauguuuuuggauccccuggaacuggaguuagacaugauuaugagccaccacguggguucugggaaccaaacccaggucuuuggcaagaccagcaagugcucuuagcugcugagccguccuccagccccuuuuuggcuaguuuuaaaaucagauccugagccaggcggugguggcgcacgccuuuaaucccaacacuugggaggcagaggcaggcagauuucugaguucgaggccagccuggucuacaaagugaguuccaggacagccaggacuacacagagaaauccugucucggaaaacaaaaaaacaaacaaacaaaaaucagauccugaauauuuuauuucacacuuaaguucuuaauguagcauggugguuuauuuuuuuuuaauugaaauuuuaagaaaaaaaauugugcugucucacaggagaacuagcacaugcuggucuggggaaacaagccagucgaguguaaagcuccccccuggccaccguagccaacucaaagcuuuagugugcaugucaucagaccugggcgguuuguaagcgcacaaaagcagaggguuacagugaaaggcuucuggggcuuuauuuaaaggaauccacccgucuuuccaacuuccugggugcucacagugcccuucacucuugaguuggugcaguuuugagucauuggugccuuccgauggccucccugagugacagcagcagcugcuguccugggaagcuaggcuguuggguuagagaccucucaguauaacaaugccugccacucaaacuggugcugacuguguccccacaucgcugauagugaaaaaguuguaguugucgccaaaguccugugcuccuuccccuaguuuugugucuguccagugaccgaguuuucuucucagguguggagaacccccugccugaccguccccgggagaaagaggaaccggugguccgggagacaaaugaggccauugagugccaccuuagugacuugcuacagcagcugaccagugucaacgccuccaagcccucggagcgcgggcuggugcggcaaggugagugcuacagagaggucugcgcgccuggggaaggcagggcugcucagucagcagagcacuggugagggcccagacccacgugaccuuugcuuugcccguuucuuauagaucaaaauccaggugaguuagccugacacccacggccccccuugguguuucuucugccuacuucugcaccaucuuguccuguagguggcugguaggccaucucugcaucacugcacauauugcucagggaauuaauuccuccagagacucagaucagcuccagcuuuagggcuuuuguacccagugucccugcccugacacccgcugccaucacuucuaaaccugacuuaauuaauucucuauagcauuucuucccagcacauuuguguuuuugcaucagggacuuguguacaguuuucuagcuguucuagcaucgcaggcagggguugucagccaacugucucucgucacuuuagucugggauacuaggccuucuaccacccccagggcgaaugauggaggggccuguagccugugcuucuucuucaucccugugguuggaacccgggcucuucugaagccugugggucucuuucccuguccgcaccucccacagcucauggcuacaguaggccuagaguacaggggcucacucgugaugaagugggccuuggcauccugggcuacaguuuuccauuugggugucagguuuguacugucaggcuccuccucagguuucauggggugccauggggagggcugcuugaaaggaaaggcgacggggcugaccuaaccauaaccaguguucuguuucuaccccagaggaggcugaggauccugccugcauccccaucuucugggucagcaaguggguggacuauucggacaaguauggccuugguaggugucccagaauguggaaugggcaggggaugguguagcuggggggcggggcgugggaagaauuaaaauucaggucuucugcaugguaggcaagcauuguacuacugaguucuacugaguucuuccaaggccuuugccugucuccuccugccuuucugagauaacccuccacuuaccaccaggguaucagcugugugacaacagugugggggugcuuuuuaaugacucaacacgccugauucucuacaaugacggggacagccugcaguacauagagcgugauggcacggaguccuaucucacugugagcucccaucccaauuccuugaugaagaaggugaguccuggcugucgagggggagcguggcaggguagggggcugccucggggccaggcccucauucuggaaucccucccccaacuuuucaaacuagaucacucuccucaacuauuuccgcaauuacaugagugagcaccugcugaaggcaggggccaacaucacaccccgggaaggcgacgagcuggcccggcugcccuaccuacgaacgugguuccgcacacgcagcgccaucauccugcaccucagcaacggcaccgugcagauuaacuucuuccaggugugcuggggcaggacgcugugccuggggguggcagugcugucucccucaccagcggggcgccuuccuccccuuugcccucccccugggcaccuguugagcucuucacucgcucccuccuaggaccacaccaaacuuauccugugcccccugauggcagcggugaccuacaucaacgagaagagggacuuccaaacguaccgccugagccuccuggaggaguauggcugcugcaaggagcuggccagccgccuccgcuacgcccgcaccaugguagacaagcugcugagcucgcgcuccgccagcaaccgccucaaggccuccuaggucucucuccuucggacuggugccccuucacucugcuagcucugagccugcacuguaggcuccugggggcugcuguucagugccccuggcccugggggcugggcaggagcagggcccccuuugaagggguugcuguguguaaguuauuuuguacaugucuggguguggguuuacaucugcuucccugcccucgcucagcccacuguaugaauuguauaaauguuucuauuaaauugggacugcucuuuccuuagcuuuauauauauuaaaauguguacaucucuc

SEQ ID NO: 12398 - RNA, 4355 nt, Mus musculus
uaccaauuuuuaaaagauuuacuuauuuuuaugcguauggguaucuugcccacauguauguauuuguaaccacaugaauaccuggugcccuugaaggucguaagaggccauuggaucuccuggaacuggagcugcagacaguugggagcugccgcuuaaggugcugggaacagagccuggaagaacagcagugcucuaaucaagaagccauuucccagcccccucaccaauguuuuucauaacugugaaauuagagacauuuauuguguaaaacacagaaaacuaaggugaaaaaucacacuuaaauuccccacguuuaggaggaccacacuaaacacgcaggauguagcuucuuacagauguauuuacagaucauuuaauuuucccgaccccacgucagccacaggcauuucugaggucauuacacauuucugaagacgaggccaggaugucacaaacacaagcuaugguuucauaacugauggaguugaaacuguuuuacaucucccuguuuucuguuugccugcuuuuucuccuccuccuccuccuucuucuauuuuugccuuuuccguaucuguuacucacugggcuuucucucucccgagcugaaggacaccuguccaccugucuguguccaccaugaucucugcuccacuuacauacuuugcauuacuagucuuuguguuaagugccuuccccugcuaucugccaaugccucauucauucauccauccauccauccauccauacauacauacauacauucauucauggggacaugcacugagugcuugcugccugccaggcaccggagucacugggaagagagauguggccaagauccgggacaagcguucagcuuccuugucuuccuucagagguagaauaccaaccacuuccuaguuuuguuccucuuguggacacuuuugucugucauuccacuuagcacccagaacaucugacccugucugggcugagguccuguugggugcuagccaccaucucuaccccauuuccuugucuuccuccaugcaccugacagccugaaacaccuuagaaguggcagugaaacaagccauugaccucucaacuuagcgauauuuucuucugagccugaaaucaggacacacaguuuggcaaaaacaaccacaacaguugcugugucccuuaagggccacuggcaacucacucgagccaucucuguuguagcuggcccacacagcgccuagugagcaguagaaauggguucaguguggcccaggugugcccagcucaguccuucccucuuccccacagacucgaggagggaacgauggcagcuugaugugguagcaacugguccaugucccuuuccauuccucauccccucccucccaccuuccccuuucccauccaggucacacacaaucgcacgcacacaucucuuucuguaggucagucuguucucaagggcagcgcccucugacucaacagcuuccucuugcacaucuccuccagcaaccaccuuuggaccacgugccugggcuggcggggucagaggcagcacaauugugaccuguccccucucuguaccucagacccuuagggacucucuggcaaccaugucccaccccuugggccugucuuucauuuaacucucucuuauuacccugcgacaagggaaagacuucagccuugggguggaagaggaaacagacaacugagccuguagagaaaagcaucaacaccagggguuugugccacccagucaccgcacuuggcugacuccucucccgaucuugcaugugugccuacuggugugugcacggugugggcguggugagagcuggugugagggagccucugagggaaggauauggcagcuuagcugaagaacgcacacuugauggcacauuuaguccccaucacauuugcauucuucugggggcugcagacacacuuaggucuucagcagacaggguacagcuccugggucccuccuuuuggaacucaccagcaccugcccugcuuucucccauggucuauauucaccaguacuguuugcagccaucaccuaaauuguccuaucuugcacacaaaccauacuucugaguggacacaguaggugcgggacuauaccaccuacaccuacaccaccagccaggaacucuccgcaucccuaacccaaggagaagugauggaucucuggcaggcucccaccagcagcuuccagccagccccaaaucagagugcucugggaaaagucacaggucacaguucacccaagagcaagcuggauguugccauccaggcucuaagcuggccccaaagcaaaugguaguugagaggcauuccugaaggggccccugcugagaaggaugugagugcaugggcuucacagcuucauccuagggaguuuucuggccuguugggaucccagaauuccaagggggauccucggggaaaauguggguccacuaagaucauccucauggugauucagcaauugguuccaaagaaagcacagaggaaggggaggugggagacagcggggcugggggguugcgggggguggggggaaggaaaugaauguauggauggauggauggacggauuugguccacaaauauucacaaaugcagagugugcggcagcuaacagcaggauccggggcuaaggagcagauuggaugaauaccuguugcucauagagauugaggugcggccucaucuuuggcuuguggaccgucagaaguugggguuuccacagcuucauccucacugcccacaagcggcucuuccucccccuucagguugggacccgacccaggcuucagcucuucuaguacuaaagagcccuggcgagacuuccgucugcugaagaacguagugagcgugggucucugcccggagccuucugucuccaguaccucagagcccuuguugcccccugccccugaugugguuguggccucuucaucaggaacccgggcuggcccagcccaggcauccaccaccccauuucguuuuccuccuccgcucagggucagggccccaguccuccgcuuuugccucuggcgccacaacagcaguagcgccacgagggccaaaaccaccaccaaggcaauaagcaugggcaccaguaacaugccacuugauucuuggcuuggugaccuggugguuaugggaucuuggguagacgucguggauguuuuucugcuggaaacugaggugccacgggccacacuggaacucuccacagaacugguugcugugguagcagggaguccaugcaucucacucgagggccccagagacccaguagcuguggugacagggggaccacuggucuuggagcuuacuguuguagccacagaggguccacuggucucguuagagcuuguugucacagugguggggggugcacugguuccuuuagagauagauguagaugcugcaguuccgucugucacaggauuggcugcagguccgucugucacaggauuggcugcagugacaggagggucacuggcuacauuugaugguucuggaagcagugcugaugucuugcuggaaacuuccugagaggcaguaggcucagguacaggggugcucaugcuggcaccagcagaagucuccaaagaagacaauucaguaguuuccaagggggucaaagaaacugggauuguggucugcccccaggggcugauggucuccuucgaguccacugucccugaccccacagaaacugaugggcuggcauucugggcuucagagguacuuggagcugugauaugugggguagaugguagcaucgucguccucugcagacugucugggcucgccaccuggacccagcaugccccaaagaggaggagaaggugcaaggccaucuccagagggacaggcaggagcaggaguugggaccugaauguagggaaguuacagaagaacgcgguuggggagggaaacuuggccagccccacuccuucugcccacuucccugccaacugccaagcccaucuugugguuuaacguuuuuuuuuuguuuuguuuuguuuuuccauucuugcuuucacuauuaucagagacaacaggggaacagauggcgccagugacucccacccuggccuuggcagcucagacuccagagcagccaugucccccuggccuucauucauuguuccagcccguggcucuggacucccuuacccccucacccuauucaucuuuucaaacuauagguacauuccuucauccucugagcauccccacccccguacccagcaagaucauacccucuuaccagauuaaugguuaaggcacagggccagggcaaguaccuccaguucuuccugaggcuuggucaggacuggg

SEQ ID NO: 12399 - RNA, 14804 nt, Mus musculus
caagaugguggcgcuuggcugacccuacgguaagugcggacccccguccggcgggggcgggguccgggagauauguccagggggacgcucaggacugcggagcuccagacgcauccacagcucagcucucuguuuucugcaggugacggaagugccgccuccacccgccugccagccccggagagcccugaguugccccuccgccaccgccgcuaugucuggccucagcaacaagcgcgccgccggcgacgggggcucaggacccccagagaagaagaugaaccgcgaggagaagaccacgaccacucuaaucgaacccauucgucucggcggcauuucuuccacgguuggugggcuuuugcgaaagucacauuuggccugcgcccaaaguguuuggaaucuugugugugcucguguguauauacacaaaccggguggugagggugggugugccaacggcgugaaugugaucagagaacaacuuuacggagucccuucuggccuuuuacuuaugcgcacauauguucccguaaguccugugugaugugucugaguuggaaacagguaggggcaggaacggaaugugaagcucucaugacuagcauauucucuuugcaagugucugagccuugcuauauaccucuccccuuucagucuaauccuuguccuauugugugucagugaugguucaggguccugcccgacacucugccucuucccuucugguaggaggagauggauuccaagguacugcaguucaagaacaagaagcuggcggagcgguuggagcagcggcaagccugcgaggaugagcuccgggagagaauugagaaauuggagaagaggcaggccacugaugaugccacacuccucaucgucaaccgcuacugggcccagguggaugccugaagagcgagcguccuacugggagaagcccugaggcauuccuaaccucuuguucuuucuucuuucagcuggaugaaacuguagaagcccuccuccagugcuacgagaaccagagggaacugucuucagggacagaggugccugggugccaagagggccugacccgugaugugaucccucgaccagacccagggacaucagaucugagggguaggaccagggcccuggggagcuuauguucucagaaagguuuugaggaggaggugacuuugauguggggcuaccgaaaugcccggcacuugggaagcagaaguugcuguccuggaacucacuuuguagaccaggcuggcuucaaacucagaaauuugccugccucugccucccgagugcugggauuaaaggcgugugccaccacgcccaucgugagacucugucuuaaaaacauggguuuuuuguuuuuuuuuuuuuuuuugguuuuuuuaauauucuuuuuuaauggaaugaacaaaguuuuagaaucuaauuggauuuucauaaucccagccuucugaaaaguagaagcagaagucuuucuguuuaucaauuaauucauuuauuuugguuuuucaagacaggguuucucuguguaauguuggcugacuuggaacucacucuguagacuaggcuggccucaaacucagagugugcugggauuaaaggugugcgccaccaccacccggcagccauggaauaccaagcagcuuauucugggacuugguagagguugauggucccugcuguggccuuucauucugaugaggauucucugucccuuccagaaccgcugccagugcaguuucgagccccucucagugagccggccuuggcuuuugugguggcacugggcgccagcagcugugaggaaguggagcugcagcugcagggucggauggaauucuccaaggcugccgugucucggguggucgaggccucggaccgccugcaacggcagguggaagaacucugucagcgaguauacagccgggguuaguucuguggacccuacccugagaaauccacccuggccugcguuguucagaguccccaguaaaugucagccuuguucuuguugggacaacuuaguucagacggggauuucagcuuuaguuccugaaguggggcucuagagagacggcuggaggagcuguugaugcuggcagggucacagcccuucagcaggagggcucucuggaacuuugcaccaaccucagggguagcuauugucccacuacacugagaggcaagugcccaggcuuuuugaggcaagggguuuuuuccuccugcccuuaauucuccucccuaguguccauuuucuuggcugaauggucccucugugagcuagcuuagucugaguuugucauaagcaguuggugagauagcuggugcauaacacugagcacagaaacuccaggaucaacuaguucuuccuugguuauccagggacuccaggaucaacuaguucuuccuugguuauccagggacuccgggaucagcuaguucuuccuugguuauccagggacuccgggaucagcuaguucuuccuugguuauccaggguuuggcucucauccaggcuuugcauucccaggggacagugaggccccuggggagguggcacgggugcgcacccgggagcuaggcagagagaaccguaggcuacaggacuuggccacucagcugcaagagaaacaccaccgcaucucguuggagguaggaguugggcuuugggugcgguuagaacuugggcaggguuuggguuugcuauccgaggaccucaggaaacaggccacuguccacugccccuaguacucugagcuccaagauaaagugacaucgacagagaccaagguccuagagauggagaccacaguggaggaccugcagugggacauugagaagcugcgcaagcgagaacagaagcucaauaagcacuuggcagaggccuuggagcagguacgagaguggaugggaccaaauugaguacuuggggccccgguuucugcccuuugcauccacugugucuucuuucucugcagcucaacuccggcuacuaugugucugggagcuccacaggcuuucagggaggccagauuacacucagcaugcagaagguaagcagccuccucccccuccccuccaggucugccucggacuuuccugagggcaggcaucuucaucagaguccguuuccuggcauugcugcacauuuuuuuuucauuccuuucuacacuuguuuauuaaauaauugcagaacuuaacugcuaggagcuaggcgggcugaagaggacgaaugggagcgggagcuuacguugucuugagaagcccaggcccgugggcgcugcccuucccugagcaucucuuucugccuugaugcuguauuucaaugugugugaaaucccuuuguguuuugccucuuuguauuggaggcuaggucuugugauguggucaggcuggccucagacuuguguagcugagagugacugagacugauccugccauacuugccuucuaaguggugaaacucuaggcuuugcaccaccuuaccuagcuucaaaucaaacguuuucuuacuaaacuucaguucuuucucuuaugagggaauaauaaagauuccguggaaaugagguucuaugugaggaauagacagugcuuacguugguaguuaguugguaguuacauugguaguuacguugguaguuaguagauaguccugugcagggcugaccuccuauucccccaagagcccuuagaaaacgcauugcuuuggaaguuuauaggagcuuggguggggugcgugcuggacgacuggggaaaauacugcccauccuggucuugccuaccacagccccuuccacuuccuaguuugagauguugaaugcagagcuggaagaaaaucaggaauuggccaauagccgaauggcagagcuggagaagcugcaggcggagcuucagggagccguucggaccaaugagcgucucaaggucggcugugguuaggacuggaagggcuaggacuaaccucagaucgauccugcugcuaacacaacccuucuggacauuucaccgccagguggcccugcguagccuuccugaggaggucguucgugagacaggggaguaccgcaugcugcaggcacaguucucccugcucuacaaugagucuuugcaagugaagacccagcucgaugaggcccggggguugcugcuggccuccaagaacucccacuugagacacauugaacauauggagguauggucuuggaggagggcuggaaaugagacuagaucuuuagacuugagacauuccucagcuuccaaggggucuuguggaccugcugagagucccuugggcauagauuguuccuuggccagaggugagacuaggggauauaucuauuuuucuuuuuuuuuuuuuuuuaaugguuuuucgaaacaggguuucucuguggcuguccuggaacucacucuguagaccaggcuggccucgaacucagaaaucugccugccucugccuuccgagugcuggguuuaaaggcgugcgccaucacgcccggcuuuucuauuuuucuuccucuguuuuuguaagaccuaggcuaagagaacaaugagcugaagugagauuugaaccacugcuaccaaagaguuacuauuucuuuaauacuccgaugcaaauacacagcgugcaaugcaaagcccgcugaguggagcacagacugccuaagauguauagaaaggagguggcucuguugggguuuuuuccuaugcaccugguucugguagcaaguccugugcguuagagcagugugugcucuggaaacuucauuuccugcuugcgggacuaacuggguccaggaccacacaagaaagagcuugcuuuaaacaccuucagugccucucccucucccuucaguggucacagugguaaugguucaaacccuuucugguaaugguuuuacaguuaaccugucuccagucaaagucuacguuuucucuuaagagaagcagugagagggcacgggaagcccccagggcucguugucugcugcaggugcaagccgcagcucugcccagugaugcaaacgaguucuagguuauuccuguuaggcuuugaucaugucaacauuuaaagagauuaagcuggauugccaaauauuuuaggacuugggaaggauggcauauguguauucaugcuauguauguguauggcguagcauuuuuauguguaugaguguuggcuggcauguucaucuguguagcacuuacaugcucagugcccucugaggccggaaaacagcauccagggaacuggaguugcagauggcuaugaaccucccaguaaugguuggaaaccaaacucguguccuuuggaagagcauccagugcucucaaccacucuuuaucagggucucaguacauagguguggguggccugggacucacugugcacaccaggcuggccuucagugcaagauauucacaagauccacaagcuauugcuuccugagugcugggauugaaggcacacaucaccaugcuuagaguaguuaucugucuuaggaucauuuaccaaaauucuuuuuuuuuuuuuuccuggagaaacaugagaaaaugaaauaaccagugcuggcuuuauuucuuuuucuuuuugagccaggguuucugugucuagcccuggcuguccuggagcucacucuguagaccaggcuggccuugaacucagagaucucccugccuuuaccucccaugugcuaggaucagaggccuauaccauccuuccuggcagcuuuauuuuuuuuauaagcaauaaaucaggucuuccgauuaguacugaguaguugcauuuucauaggguugugugucuuucauacccaacccugcagagugaugaauuggggcugcagaagaagcugcgcacagaaguuauccagcuggaagacacccuggcccagguacgcaaggaguacgagaugcugcgcaucgaguuugaacagaaccuugcggccaacgagcaggcugguacgucgugggauuuggauagaagugggccucagagggguacuggaccaacucacccauggcgcuuagcuagaugcaauaaguugagcucuuuucuuuucucagagccucaggcugccacaggagacagguacauuaccugucucacagagagccugagagaugaaaagcugggcaggcaucgccagacugagcuacucuggccucuauaugaagauuuguuuuacaaagacuuauuguguaauccugugagccaaacuccauucugcauucugggguuuugccaauaaacagaguaaggcaucucugcuguucccgagggacucuaguggaggagcaguguacaauaaaggaaaagguaaaaugugagagagugaaaacgauuuucauaaaaaugcaucaggaaaccuagcaugauggcgcacaccuauaaccccugcacauggggaacagaggcagggagagcucugagugugaggccagccuggucuacagagugaguuccaggucaacaaagguucauaugcaaagcacauaaaauaaaaauaaaucuuuuuaaaaagaaguguuuuuguccccuauccaccucccucuccgccucccacuggcuagagcgguggcucaguaguucagagcacugacugccuggcucuccuagaggacccagauuugacugccuguacccauaauucccagggauccagcacccucuucuggccuuugaguacacuacauugcaaacacguggugcauagaaaucuaaguaaaacaccguacaaacaaagugaaauuuagaaacuaaaaagacuaauguuucuguguguaagcauuuugcuugcaugcauguaugucugugcaucucaggaaugugugccuggugcucagaggccagaagauccaucaccuggaacaguugaaguugcuguguaggugcuggaaauugaucacgagugcucugcaagagcagacaguguucuuaccuaccgagccguuucuccagccucugaggcuuugucugcuucucugugggcacugacuccgucuguggaguuggugagcugaaggagacagcucagcacacucacuugcugaccuuuccccagggccuaucaaccgggaaaugcgccaccugauuagcagccuccagaaccacaaucaccagcuaaaaggagaugcccagcgauacaagcggaaacuucgagaaguacaggcugagauugguaaagugaguagagggaguuuccagggggaagucuuagcucgaccuuagugagcaguucaucuccuuccugcuuuucucucucuuuaacagcuccgggcacaggccagcggcucuucccacugcauucccacccugagccacccagaugacccuggccucaaugcccuugccccagggaaggaagauagugggccaggcccuggagguaccccugacugcaagaaggagauggcuuuauuggcuggagccaccucugcuacuucuuccauaaagaaagaggagcuggucuccucugaagaugacgcccaggcccuaaccccuguaacccagggcuugcccuccaggggucgagaaccugaggccagacccaagcgagaacuucgggaacgggaagggccuagccuaggacccccaccugcagccucaacucugucaagggcugaucgagaaaaggccaagguggaagaagccaaaaggaaggaaucggaacugcucaaaggucuccgagcagagcucaagugaggcccuacuacuaucucauagcccugucagguaguguccggcuccuccugcuaagaccccuccuguaccuuuccccaggaaggcucaggaaagccagaaggagaugaagcugcuccuggacauguacaagucagcacccaaggagcagcgggacaaggugcagcucauggcagcugagcgcaaggccaaggcugagguaggggcggcuagagccgagaguccuucccaggcacuuccgagccuugagccaacaaggucacuuguuuuuauucucacuguauggaccaacguugagggcuuccuucccguggaugcagguggaugagcuucggagccgcauccgagagcuggaagaacgagaccgaagagaaagcaagaagauugcggaugaagaugcccugcggcggauccggcaggcagaagagcagauugaacacuugcaacgcaaauugggugccaccaagcaggugaaaagcccuguggucuccuugcuucugaaugcggggauucccuuagcccucccuguuaagugccaucagcguguggcguuuuggucugagugugcacuguuucuuuggaguuccccggcacccaucuuguugagcuguguuuucccuuuccauccucccuccccacuugcaggaggaggaggcguugcugucggagauggauguaacaggucaggcuuuugaagacaugcaggagcaaaacgggcggcuacuucagcaguuacgggaaaaggaugacgccaacuucaagcucaugucggagcggaucaaggccaaccagauucacaagcugcuccgagaggagaaggaugaguugggcgagcagguucuuggccuuaagucccagguacggcagcugcaguguggugcuuguggacgaggcugaagaggcugccccugguacugaggcuucccuccucagguggaugcccagcugcugaccguacagaagcuugaggagaaggagcgggcucugcagggcagccucggggguguggaaaaggaguugacucugcgcagccaggcucuggagcuuaauaagagaaagguaaggcugggcuuuuggauaugguaacuugugauuggcucauguguucccuccgucucugcuuggcaauguuaccacagauggcccagagugaagcucggcucugcuccuggcaagcuccucaggacuguuaccauaugugcugugugucaagccuugcacucaguaccuagcaugcuugauuccauuuccuuuuauugcuguguggucaugcugugugcauacauuuaugugugugugugagugugcuuucccacaaggguggggacgaaggacgggauugucaucgggaugucccccuuucccauugcuucugugccuuaguuuugaaauagggucugucgaugaacuuggcgcucuccauuuuagauaggcaggcuagcuagugagugaaucccugggcucugccugucuccacugggcuacaggugugcgcuaccgugccucgguauuuucaagggugacaggguuaggauucaggcccacgucgccugcacuuuacccacugagucaguuccccagccuguuuuggcccugugcuaaacucaacaauaauccuaccaagguuuuuucuaaggauugguuuuguuguucugcauaugucaggugcccccaggggccagaaaauaguguuggaucugcuaaagcuggaguuguagagaggguaagcuggcgugucagugcugggaaccaaacuugggucucugcaagagagagugucucuccagcccagccaaaaggauuuguuaacugucccaccauugaggaagcucagacucgggaaaggucagcugauuugucccagaaagagaaaagcugggcuuugaauacaugccuuguucccaaguccucugcuggagccauucaccuaggcuugcacaguggcucagcugggcaaagacaauugccucuaaaccugaugacccaaguucugucccugggaucuacuuggcagaaagagaaagcucucacaguugcccucugacuuccacaggugugccaugguuuauauaccuccccccaccaccaccaaaacacacacugaaugaagucauuuuaaaaauaaaaaaagaacuuaaucauuggguaguuuuuuggauuuuuuuuuuuuuuuuuuuuuuuuuacuguggguucugggauucagguccacgcgcuugaaagguaagcacuccaucagcuaagcuaaucucuucagccuguaauuguuuucuugcucaccccccccccuuuuuauucucagugaguguaucacgauagauuugaacuugugugugucuguguguauaaacaaggucucucuauuucacucugaccauccuggaacucacuggguagaccaagcuggcuucugucuuuguaccacaagcuucaacuuuccugaugcacucagaagccagaagaggguauccgauacccucaaacugcaguuaugauggcugugagcugucauaugggugcuaggagcugaaacuaauccucugccagaccugcaaguguguguaaccacugcccacugaaugaucucucuacccaacuugagcucuugauccucuugccucaggcucccaggugcugagagcccugauauuuaauucaagcauaacaaaaauggacuggagaugaagcucagucaguaggcugccugcagagccugcaucaagcucugggucagucucuagcauaaacugggcacggaucuguauguaaacuggccugggaacuuaguaccugcaaggucaacagggaguucaaggucacccucagcuguauagcaagucugaggccagcugggcugggauauuuagagaccuugucuuaaaaggagaugcagagaggauuaagauggaggauugacaggcuggagaaauggcucaauggcugauagcacuggcugcucuuccagaggaccuggguucaauucccaacacccgcauggcagcucacaacuguaguugcuccaguuccaggggucucaacacccuuacauaaacaugaauguagacaaaacaccuauacacauaaaaaauaaaaguuauuaaaugauuuuaaaaaggacauggaggauuaacauuggucuuauaccuauuggaauauucucuuauggugaguuuauucauggaagcaguguuuuauguccuauuacaugcugcugaccgacacugggugacuccugccuucucaccaguaauccacaaagaaaagaaugcacuuguccaucguuuaucucuuuucugccucccccacccccuuuugguuuguuuuuugagauagucucucuaugucguccuccuggcuguuauggaguuugcugcguagacaaguuuucacuguauuccaagcugaccucaagcucucaacuauccuccugccucagccucccaacugcuagaauaucaaauacacaccacuguaccugcuucaaacacuuugaugaaggaaacuaaggcugucugagaacauaauggcacuccuuagggaugugacuuuaaggcugaguccacgggacaguauacauguuagaggaguugauggcaacagagagacuagccuacuggaggcucaaagaccagagcgagcaccaucaugcaguaaggagcugugucaggaaugaggaugcguaggaaggggugagguugagggccacaaggcagggucagcuccacugcaggcaggcaggcaggauguucaacagaagcaucaauggacugugguucccaggcuugggcccaagguccucuccuucccguucccgcccaccucaggcuguagaagcagcccaguuggcugaggaccugaaggugcaguuggagcaugugcagacucgacuucgagagauccagcccugccuggcagagagccgggcugcccgggagaaggagagcuucaaccucaagagggcucaggugcguccucggguggggagggcugguuggccgguaugggagacaugcagguccuuagccuggcuucugcuguccuaggaggacauuucccggcuucggcgaaaacuagagaaacagcggaaaguggagguuuaugcagaugcugacgagauccugcaggaggagaucaaggaguacaaggugggacgaggcuggugacagugggguguagucuccggagcucgaaaauaaaguagggcagcaggcgugcguuguauguaagccacguggcagaggagagauuacaccuggacccuggcagucaauuuaaaguaauucugccaucucagugaugagucagggccauggcaagaacccaguggagucuccagaguggcccuggggaugggauggaggguuguguggcaacaggcuuccuggaaggaauugucaccaaaggcagacccaaagcuccaagaauggaggugagagcuuauguaaagggaaaggccgcagguggggagugaaggcugaacagcagcagacccuggaggcuagagguaggcuugguagccugugggcaagcagaguagagaagccuuuuuauuugggagggggaggagcauacgaugcuugggaguaaaccuggguaggacuuuacaugagcugcacacacacaccuuaccaccaagcugcauccucagccccaucaaggguuuuuauucaagagaguggccagauauggggccaagagcggcugcagaaggggggggggguuguuagagcauugcagucgcugaggcagaaacuauacauagcuaagcccuacacaccugagacgagaugagcuaaagcaauacuaagguggagcugcggggcucagggaugggucacagaaggauagaauaggcaggacaccagggagguccgggguugagauauaggaacuagguagacaaacacucuucaguggauuaggaacaugcaguggaugguuucaaggugaugagaacucggugccucugggaccucuugggaggcugggaaagcacugaagccaagggucaacugcaacaaccaaaagccacacuggacucuggcugccauugagggcucuugccaugagaaggaacaggggacauucuucuuccuuagaagucucagcuuuuaagugacaggcauuaagugaagccuggugaguggggaaagccuugaugggagggguagggaaggaaggaagggagccaagccagggaaccuggguagaacaaggguggucagagcucccggucucuggagcacugugguggagaagguggcagagucauugauuagcuauccccccauuggccuucucggggaagacacgagccuugaaaggcuuuccagugugcauggcccuguccugagagauggagaaacaguaauuuggggaguugagcuggcuggcugagacuccaaauaggccaagcagugcucacccaagguggugacuggagccgacacugagagccuccugguggcaguuggggacaguccacagcagggccuuggcaccaggggugggucagacugacugugcagauagcaugcuucucacaguucugcccuguugagcagugacugagcagguacucgagaaaugacaagugaccacuuggggauuuugcccaaaaaagcuauuaaggcaagagaugcaggaguuagggccuaucccuguccuuaggagaaccuagacacuuucgaguuuuguuuguuuguuuguuuuuguauuuguauuuuugguuaguuuugucuuuuugaggaaggucuuaacuaugugacccuggcugauuauggucacagucuccuggggacuauagguguaagcaacucuaauuuugaaaacuuggcucugagccuguauccucguucaugcagugcugguucccaccuucagaaguuauguucagaauuagaggccucaaccauuugguggccuuagccuggagucuggggacagucagacuugcuccagacuuacuguguccguuuggucuaggcccgguugaccugccccugcuguaacacccgcaagaaggaugccgugcuuaccaagugcuuccacguuuucugcuuugaaugugugcggggccgcuaugaggcccgccagaggaaaugucccaagugcaacgcagccuuuggugcccacgacuuccaccguguguacaucagcugaaccugaaacucaggggacuuugaacacccgaggggcugugccccagcuccccacucccccaggggcaauggccccaaccucccuuucagacuccaugagcccagccccuaugugccuagaugguuuggggcuacuggugcgugcaggagagguggggucacccaagcugagugccaucuuuuccugaaugucagaucugcagccucggggacucccagguacacagcauccuacuguaaccuuggaagcugaccaaaaccuguuucuacugagaagacagauacauccuuaccccuagaagggaauuccuccaccaggaaagggcucaccacccaucugcacaagcucagugcugaccagggaccugggcuucacauuggguccuggcccgaggagccuugcuucacuuacuuagccccaggccugggcagggauuuggccuuccaguggaguuuccuguacccugguguagcuuuuguguugaagacacucuugggugugcacccuauucaggucagggacacugccaccucauggucugauucaggggcauuuuuuuuuuuagccagacucuuuccaaucuccuccuuuccucccaaguccacuuuacccuuucucacgcauccugguggucccuuggguaccuggcccuagcccugcuuucuuucauccuggugaucuuaauuguggaggugcaacuugccaggagggaagaaacaaucuagcacuugcaggcauuccagguagaagagcuuugcccgugcuccagcuagccuacacugauccugccuaagcaggguccugaacgccggagacagggucugcuggagcugggagacggcgcugcagauagauggcuacaggagcuuuuggacucacagccucugcucuagagguguuguguaugggcugcuaauuguuaugaauaaaauacccaacccua

SEQ ID NO: 12400 - RNA, 49420 nt, Mus musculus
uuucggcugugguccagcccguggccgucggagucgucaugcagucccugcguaccacgcuccugucuuugcuacugcugcugcuagcggcuccuuccuuggcguugccgucggggaccggccgcucggccccagcugccaccgucugucccgagcacugcgaucccacccgcugcgccccgccgcccacggacugcgaggguggccgcguccgcgacgcgugcggcugcugcgaggugugcggcgcgcucgagggugcagcgugcggccugcaggagggucccugcggcgaggggcugcaaugcguagugcccuucggggugccggccucggccacaguacgacggcgcgcacaggccggccugugcgugugugccagcagcgagccggugugugguagcgacgccaagaccuacaccaaccugugccagcugcgcgccgccagccgccgcuccgagaagcuucgccagccgccggucaucguccugcagcgcggcgccugcggccaagguacccgccccgcccugcgcugcacuccuggguggcuccccacucucgccaacucagcccgaccagucaggaccgucgggaggggaugcggaggugcagagaagcacugcgggguguucuaggcauccaguuagugggagagagagacgauggggcucgggguagcuguguuucaaaggcucccuccggcccuauuucugcgccaagcaucgggucguuucgagaaacgccaagcaggugcuuugcgcgcuuugguccagcacccccuggccggggugacuaggcaucgcgcuggggaaagccgcguaucauaccagggaucuuggcaauguugagauacauggcuuugggaucgcaagaacucuugucgccuucccuuccuucucccuuucugcugaguccucucuucuuggaacuaucuaagcaguguuuuucuuauagaaccucuucgugaaaacuuucacuuuggggagagggaacaucucugcucaacucagcaagcauuuuucucaccccgccuccuaagcagaaaacgauuuaguaacuccggcccucuuccuccauugauuuaaaucaacuuuacaaaaacgcccacgauuugguccuuuuuugguccuuugguccuuuugccugaguucaaccagguaguggaccgugaaauuugagguagaggaggggcccacuggggaugaagaaaaaaaugcacccucuacccucucucuccuugugggaccuuucuguacccacaagagcuggacguggugguggcgacaggguaaaggggcuuggagaacugcccagcucccugcaggaccuuccagagaaaagcuucgguuaaauccagagauacccuguggaaaaacaguaaauucauacuggccacuacagcgcuguggggaccagccagcugggcuccaguacauuuggcuucagcuacagggcuccugcccaaaccuagcaccucccuccccuccgcccccccaccccccaugugguggggaggacaggaaagcacgggagagggaaagagagauugagcuagauuuuucuuuauaggaauauggucgccuaugaccacuuugaauuuggcaaaacuuuacucgaaugcacaggaaaguacuccaggugguguaggaagaggugggcugguguuuauauucuuaccacaggagcacaggacuggaccucagucccaggaaacucagccuccauagagagaagaaaaggguuuuuguuuguuuguuuguuuguuuguuuguuuguuuucagagaggacugaucccggggucccuaccuacuaagucccagcccaugugacaagugaguuauccugugacucuauuuggucuccuagacccgggaggaggaagcuccuggccucgucuuugucuuagaugagguggaacuggggaugaauaacuuguccaaggucacucagcuggaaccugaaugcuggcaaacucagaacaggccagagcuagaccucaaggcuaugggaaaugggcuuccagggggcuggaccagccaacucaccuuggggagagguagagaacuauguagcuccugaguggauacuuugagguggagaauagauugguguuaguuaguuaguuaguuaguuaguuaguuagacagacacgggcagaagugacccacagugguggcucagaguccccuggggaggaaguagugugucacacgugcagauauccuugaguaguucuugaauaggcucuguucagaggagggcuggcguagaacuagccuagagggggagggcagaagguaggaaucugggcuacuuucaccagaaucugagugugcacaggugacauuuuuuuuuuuuuuaaaaagcacauuuuggugggaaaccagguagcugucacucuuuguagucuugcugcacaaggccaggaguuacagacaucagcagaggccaaauacuuggcugguugaguuguauuggggagacagguccuuuguuggccagcagggccccaguggccccuaaguguggagacagccacagaugaagcauagagcuggugguagccaucuccccuccuuuuguaaauaucuguugcucuguaucacgucugacaugugugccugguacuuagggacagcuaguuacgugggaggauggauagaaagacaggagauacuuggcguacacagccgacccucagccuggcuucgcccugacucuccaucugaggcugucuuaaggucccaggagcagagucugugagucagugagcugcuuucauucagucccuuucuggcccccgcuuuuagcagcugguguccagggacagcuaguguacuugaugucacccuugaguaaggagaacuggcugccugcuucagagcaaagugcaggugggaguggcguggaagcuggguggacgaagagaaguaccccugaggaggacaugaagggaauccacugugagaacacacugaggccagagagguccugaggcaggaucugggcagaaagcucaggagaugggugggaauguggggggaggcgauguccaaggcguugcuuuagggggucacgauggccguuuggagagagaagaugccaucacucugcguaaaacucuugucuguaaguugguuaaugaaaaaucagagaccauaucuuguuuggaaauagagagaaauuaccagugcuccagaguguggcugagacaugcacaaguauaccagaggacaaggaucuguuauuuacuacugaccagaacauaagaagaaauaaaaaaauaaaugaauguggugguucacgccugugacucuggcaagagcuccauggguucgaggccaguuucggcaacagauuaaggcccugugucaaguuuaaaaacaaaguuauagucauauaggguaacagcaacaaaggugccaucugauucguacuucuucuucgggcaccuguuuaccaggccguugguucugcuaacagugccaaugcuguaauucucuuggugcagcugaccaucacacagcagcaccuugagcucauguguggaucgugaaccuguucauagccaccgcucugugcuguugacagagcaacggagauuacaaaccagauccagcuaaguagcagcuaagagcugaaguaaacagugcuccagauggccauggcuuugggacgacgacgagggaugacucucuccuuuaccaggcacagaaaucaggacaaaguugccuuuaguuacugccucaggagaagcccagaguauaagcaguuguagaaaagauguuuccagcaagacucccagacggguaaacuguucuaggguaagaagggcccuuuuggauccugagacacuuuugacuaaccaacaugugaggugcugcaucuaagaaaccaggaaaaagacucuguggauaggagaaacuuagucuacccauuccuuauuccaggaaagccauuccuacccaagacauccaaacugacaagccuagaggucuccaagccucauguggggcagagguggccuggagagggagagcuagagguuuucagaaguuuccccuccuggccucaccccggagccucugauggcagagggcacagaacagaacucuuggaggcaugaacuauuuauaaaauggacuuuauuuagguaguucuuuuaugugagccuugagcaggcugucacugugagcuuuagugccuggccuugcuggccucagaagauucaagaggcagcauaaaaucccuccccugaggaagcucguaguuaacacagugcgggcaaagacagucacucauuccuggagucuguuuucuuucaucuacagugcaaguuuugcuauuggcaguuggaugcacuuuuugucucuuaaaaaaaaaaaggauaugggguggagaugaaguuucaucuuaggaucggguugguagaaagcaugaaugagguuucugccauccuaaacuggcuuuugaacagcccaucucacuggcugguaucuuucuucccuuaaugcucugaugguuugcuaaaguguuaaauagcaaggcuugauaaaauuaggauggaaagccaggcguuuaguuuacuuuaucccaucccagggagcaguaaauacauugccuuggaacuugagcgagaucggucagggacggcgggacugugagcuagcuggccagaugccugagcacggcaggaugaauucugaguugguuuggagccuggugauccugggcaaauucugugucuuggauucagacaucagauuuuccaugggcuuacauuucucauggacaaagcucuggggccggaugcugugagggaguagucacacuuggcuuugagugcuuugaguaccgaccccuggcucuggccugugugggucccagcuccucuggcuuucagggccacaccagugaagggucugggucaguguuuucugagaucccuuuuagugaggguggccugugagucuuguaaggaaaccgccagucugugaggaggcugugcuccuguaucccuuucaaaggcuuggaugcccucagagaugcucgccgccuuaaauuaugauggcuagagccaaguuuggcauugaagagcuguccccaucuugaccgaagccaccuuuacuucagcuuucagucaacuuaugagucuuucugugagucagugggagucauaugcccacucccaagaaccaaugccacaggguaauucauugcuccucucugugaccuugacccuuccucuugguccuucugguuaagguuccuacugagcuguuucuuuggcuuugccauuuuucucugacauuagaaaagcaaaaugcauccgacagagaaaccgaagaggguaguagaccacuugaauguuucccuaaagacucagcaacuuuuggaaaguugaugugacucggaccuguuaaaugaccacgggauuauguuagacgggacagcaugcuucagagacagacaugagugguaauggggguggggcaguuagaguaguggaaggacagacuucagcuuucagccagugaugaacaucccaaauccauccaaaacuuacuuacuuucuuuccuuccuuccuuccuuccuuccuuccuuccuuccuuccuuccuuccuuccuuccuuccuuccucccucccucccucccucccucccucccucccucccucucucucuuucuuucuuuuuuucgagacaggguuucucuguguaguccuggcuguccuggaacucacuguguagaccaggcuggccuccaacucagaaauccaccugccucugccucccaagagcugggauuaaaggcaugugccaccaccacccggcacuaaaccauuucuugaacaaugucuguguacucagaaguauggaaaguauagggaaugagaggccaaauuggcugaccuuuuuuauugaggcaagaggcuuucauggcgccugacugugggccaagcuuccuucugaguuucucuuucugaauaugugacugguuuccccucuagucaaacaaucguggcaauaaguguuugcucacacuucuuagugcuauuagcauggaaggaccucguuuccugaagugguuaacaccaucugguguacuucuagauagaacucuguccugucagcuguaaugauaacccuggucaugaccaucccaucaaagcuccagugagguagucagacagcucagaagaaagggcuagaaugucuguccuguggaacacuucggauugguaaauuggguggguuaggaaagaugcacagagaaggggugauggaaacgcauccugaggcugacauggaguuugcuugucuggaaauguucucuggagucaaaggcugcuuuuccauagccucugacgguccagucccagccauuaccccagcauuaaucuucugaaaaguauaugggcuuccucugagguggcugcauguguggggaaccugggagugugugugcgugugugugugugcgugugugugugugugugugugugugcgcgcgcgagugugcacagagaccaucaguacauguuaagcauuuuccucugucauguucccccaccuuauauuuugagauaggaccucucauugaaccuagaguucauagauuccgcuacauugccuagccagcaagccccacagacucuccucagagcugggaugauagagguaaggcuuuuucacaugggugcaggagauggaaguggggcuucaugcuugugccucaguuuacugaccugagcauuuccucaguccuuacgacuuuuauaagaacuauuucauuuccuaaguuggggccuacaggagauggcagucaacagacacucuaggcccuucuugaaccugguuuuguuuuuauguucuggaaauuccucauagggaaaaaugugucaugucuuaaggaaagaggggaaaaaauaacccaaacaguuugggaguuuacaaaugcccuauuauuuugauugcuaggacaguuuguugaguuagcauauuucauacaugguccuguauagcauugcuugacagcaauugcucccuagccacaggacaggcacauuugugcacugaauucucggagggcugguugucgugguuggaauuuucgauaauuuccaaauuugaauaacccaugucuucaugagucagagccuugugcaauauuucagacuucaggaacgucuucuucccugguugcgcaaugagcucucuagaaggaaggagaugcuaggcugccuguguaaugaguguguuugucucagcguggaugagauguagaauucccuucuacacagccuuggacaagaugcuaccugaccauccaauacucgggcaucucacacccugugacuaaggcaaguucucuauuuggugcccauacucaaagcaggagucaucacucuguggacagauggauacagauuguugccaguugggguugccucaguacaugccagccagcuggauaugggagagggagggcucaugcagaaguaaacaucugcuuuuuacacacacacacacacacacacacacacacacacacacacacacacaugcgcacacacacggugagcuacuugggucaggaugagggaaaugucaccaaaccacagugaucuaaagagugaccaccacuguucuaacugggugacagaccuugucuuguuccgugguagauaccgggaaggccgccuagcuauagaaacaguagagguuccaagagguuucauccaccuggggccacccacuaaggagagagcuaggauuugaacuuggagccaccucacuaccagacuggggacuuccuugacucgggcuguuuaaaagcaugcugauuaaucuucaaauauuuggagugcuuuccagccuccucccuuuucugacucucugguugaguucugcuguggagaacaugcguggugauuuccgaucuuuuggauuuauugggguguauuuucugaccuugacuguggucagcuggugacugcucccgcugugcuuccgaagagcguguguuccgcuguuguuggcuggaaucuuccaaauaucagcuguaagguauugguggugcuguucagaucaacuagacacugacuuugcaccucuguugacaggguccgagagaaggacgccaaagcacccucagcuacagucugucuucugggacuccauuuuaggaaacuggaccuccucagccccacccccaccccggcacgaguuacucucuguggucuguuuccugguguguugcuuaaggauaaugauacuggccuggggaacaucagcaggguauuguggggucagauaaacuaaugagauagugaaugaguuuugucaacugggacuaugaaugauugacagauaccuggacugcuggacaguagguccagacucuuccagaucucuugcuaacaaacaaacaaacaaacaagcacccaccaagacugauccagaaaagauagaaaaguaaggggcaugcuuacugggucacucugucuacggucacugucaaauaccugagacuggguacuuuacaaaaaggcuuauuccccucacuuuucgggaggugcaggcguaagcucgagucugguagagaugucauggugggugguaccaugggaaugugaacuggagagaucaugagacaacauggaagucagagaggcuuguaagagcuaaccagggacccaggaaaacugccuuauuucccuguaagggccagacccucccaguuauccaguugcuuccuuauaaggcccugucuccaaaauguuccacguuaccuccuaacagcaccgcauggggagacacguuuaaaccacagcacucacucaucguugccaccauggagucugcuguacuuuccgcuacucaucucuagccacaccagcuccucauuuucauguucccuuagcuuuuguggaccaagacacugccuuguggagacaccagaggcuggccaaagccaccaccuaauuguggggaagacaguaucccagagcaggugaccuggggcugaaaggugcuuccggcuuacagcuccauuccucacacugugggugggaaagcugaggcgccggaagggaacucacaagcuguguuauuagacuugcuggaguuggagccuggguccuggcagccuuaacaaacuacuuucaggugcauguucuuaauaggucaguuaaagacacaguagugaaaagcagaaauaagauauucaguguggccacauggggaagaaagaauagcccagugacccuuccuguugauccgugggaauucugacaugagguuuagauuuauuuauuuauuuauuuuaaaauuuuauuucauuuauaugaguacacuguaggugucuucagacacacaggaagagggcaucagaucccauuacagaugguugugagccaccaugugguugcugggaguugaacucgggaccucuggaagagcagucugugcucuuaaccacugagccaucuuuccagcccccaauguuucgauuuaaauagagggucagagguaugcagcguaagcaguccaggucaugguguggucccaccaucacugacccauuauugucucugcuccagucuuacuggaaagaugcucucacaugucaggauugugugaaacucuuuccggaaggcaaguuccuccucuggauagcacugagcuucacccuuuuucaucucucagcaugagauuccuggggacauuccaacuccuugggaaccauuguuucuagaguaggauagccaaagguggguagggugggguaaggugggauguuacacaauagacuuuuuagaauaucugcauaucuggggcuggagagaugcucaguaguaugaauuucuuuugcagaggacccauuggguucucaguauguugggugacuuggaacugcccacagucuggauaauccaauaccucuucuggcccucaccugugcaaaccccacacacaugcacacagucagaaugguuccagcugcguauauaugugcagccugguaggagccgacccuaagaacccaucuucgcagccuccuucuggaguggcgguuagguguuuggaggaggcugggguccacaugggcgauuuucccacgaggcccgaggaacaguaggcguucucacucagucucgcuuuucaaaauggcaucgaagagaucuuauuuuuuccuacuugaaaagaugacggcaguggacugcuuggcaauccgugugguaacugacuucucuccucaggcauuuugaggcccuggaauguugauugcaaugcacuugccucagggaaacaucugcacaaauauccuagugaaugagucagugcugaggagccucggugucuaaaccuaucuaugguuugaacuuggucaggacgagccugcuuucuucucuucagacaggcuuggcuucuuucuuccauguuauuuagccaucgugggacucccuccauauaucucaugaugaucuaaaguacuacucuaccagcuuuuaggaaucagagucauaaucacaucaaaauacacaagggaagagauucauguuccuacggacucaggcuucacccccccccccccccgccucaccucuggagaccauuguugcauuguuguuagcaggucaaagauuucauuuuaguguguugaacucuuucaggacagacaguaccaaguaugguagcaggagaggaguggauagguuugcuguagcccuugguauuuauugucaaacucuuuucaaaggguugcuacaguccauugucaccagugaucaaguguuuguuaggagggagugugaaugucugugucugggauucuuauguacauaccuauuuguggugguccugaguucaggggucaaucuuggguguuucuuuuauuuaaagcuuuauuuauuuagguauuuuaguguaugagugcucugucuacauguacagacagcacaccagaagagggcaucagauccuaugauagaugguugugagccauccuaugguugcugggaauugaacucuggaccucuggaagaacaaccagugcucuuaaccgcugagccaucucucuagccacuugggugucuuuccugagugcuaucuugguauuuuuugagaccugggucucacuggccuggagcuugccauguaggcuagacuggcuggucagcuugccaagggguccaccuaucuuagccuccugggcaucugucccugucuucuuguggauucuuggccuugcacucagauccucaguguuuguguagcaagcauuuuacugacugagcuaccuucccagcuguggaaggucaccuucccaaguugcugaaagucuacaagacauucccuugaaggaacuccuucaugauaaguggcagauguggguccugagccaguagaaccacucagucuguagguuuuccuguuuguugccugucggcaccuuuaucuccagguucaucaccgguaaggggaagucguguuugggguagaaugagcacuuaaagagauuggaauuaucuggguucgugaguugugaccauagcucaucuaggcugaaaaggggcuuguggcagccacaucagccuucugguuggucgcuuguauuuucgaugauguguuuuugaggagccugggucaagugaggggaugugaagguccagggacauuuacccaguguaugacagaaaauggaagucgcugggugcccagucagggcuuacuaaguagaacuuucuagaugcuaguucuuuccaggauguggacuaaggccagaguauuucuguuuugaaaagugaaaaaugugcuuauucagauguuuuggacgcaugcaaggcuguaaugugagccacauaaacucacuuugcuaguucgauaguuccauucaaaaagaaaguagaaacaugacauuauuauuagcuuugauuuuaaugacaacauuuucaagacauaauucacauauaggguuuuuauauguccuuggugauguggacguaucaucccuaguuccagaauauucucacuaccucuaaaauaagcauagcacccauauuucccuuugccuggcucuagccagcuaccagcuuacuuucugucccugggaauuugccucuccaagacauuuucuacaagugggguccuauaauguggucugcugugacuggccucugucagauggcaucauguuaucauuuuuaugacuaaaaaaaaccuucucauugugugguuaugggaagacaucucucccuguugggggauacauaaacucagcccugaaagucacuuugacagucuaaacugcucagaugguauuaauguauuaguggcuaugaaaccaaaauuaaauauuccauaaggcugagaaucccacauugaaaagaucacaaacuguacuuuucagguuauuagaacauacaacuuuuuuguaauuaaagaaagaauguuggaaauggucucgccgcuucccucauuuaaccagcaagagaccuagaaagaggaagugcuuuguuucugaacccagccccccaaccccaacccccuuuccuucugggguacaucucagguuuguaagacccucugcugucuggcuuguccacaggaacugcagcucauuggcaagcgggcauuggugcuucucugggcucuagacccaguuuuccugccucuagagaaacagccuccugggccccaccucccaacucugccccggagguuggaguuucaggggcugagcaucuaggcagccccagacaaaacaaccagaggaaucaagagcaggaagagagcucauuugagaagucugugagggucaguccuggagccagacucuuaucagggaaagugguuggagguuguaggaccugagcugucagcuguuuuccugcaguuaauaauagacacuugcaggcuguucagagacccaagcauucaccaugggcacacgaacaagguuacuaucauuuucuuucucuuguccucgagacggaugcaacuuguuuuuuuucuuuuuucuuuuuuaaugaaagcaucauuuaacguagacacaugcuucuauaaaaggcaccuuuccccaggaaagccaaagcuacagaauuagguugagcuugugagucacagcacaauuaggggcugcgggccaacuggccagaugcccccaguuggguccugauguggccgguggugggagacagccuuagucuuguuugggugacccaacccccuuccuucuaccugccaugagugaguggcugggcaccugggcugcagccuuauccuagcccgugcaagcagucucaugcacuaccuucagcagucacagccugaggucuggcauagggcaagcuuuucccacguggagccgucugggagacuguaccggaaagaggggcugccagugcuuggaagugccagugugggcuggaaaucaaggccaagcgccuuggcuccaccuccucuuccuucuuuauucguuaggaggaaagaaagaggucacaggaaacucuggaauuuuaugcaaaagacaggggcuggugcucucccccucucucccucugcccuccucccuuccaacucccucuccccuccccucccucucccccucccccucucucuccccuccccucccucucccccucccccucucucucccuuccccucccucucccccucccccucucucuccccuccccaucucucucacagggucucaaguauccagguuguccuugaacucacaauuuacucaugguuggucuugaauuuuugauccuccugcaugcaccuccugugugcugggauuacacacggugugugaauuggagauuaaacccaggacuuugugcauacuagacuguagagagaauaucuuguguauuguauggaugcaucaccugucaauuaaaaagccuguggccuaugguuuaggcaggaaauagaggcaggagauuggccaggaagaugugaggagacugaccaugguaccugagcacagguuagcagucacguggcagaauguagauuggaauaaauggcuauuuuaaguuaugaucaagguauuugcaaauauauuuugaguccgagucuuauuucugggcgcauggggcugggaggaagagccaggcccaacuuuaacauuucacauucagccaacuacauuuuuugaugguaggaaagaaaaaacaaaaacaaaaacaaaauggaaccagacaugguugcaaaaauuuguuacccuaguacucgggaggcagaagcaagaggauugccacaaauucagccuggacuacgcagaugacugcccccacccccaguaaaaggaaaaagaagaugacucaguggacaaaauccucauugcauagacuucacacccugaucaugaaggagcguguuuuuccuguccccuucuuguaccggaugacggcacaggguuuuggugucagguucaucuuagaccuccgcuggcugucucugcucuuuuugugucuuuucucugcccaggccccucucuucuugcccuuauccugugcucaacaaccuggaauguacagucacagugccacucagaaaagggauucuggcuuccuggaacguucaaggucuucuuucuguuucugcugccuucccaccucagacccagcauuggauccaggcuggcuggugacccuggaauuuaacagagugggacauacagaacacagccauccagacugcuaugggcuuaugggccuggugguucaucuucagugcgauucccggguuauacucuuucuuauuuuucuuuccuucgggcacaggaggccuaucuccuauccacuuuauaccuccucagcucuacagauuucccugaccuucagagaaagcagcccaaggucacuggcagagggagagcccugugagcuucccuuggacccaugccucuccuuggagcuuuccaacccuccuccugauucuucucggaucuggacuuuggcccuuggccucccaggccauucucaaauucagcaagaacucucacaaagggagcucuuucuuggggacaagucgcccgucccacuccaugauggugcagcaugccccuccccaucugucccccucucuggcuuuccagcacacaccccuccccagccgcagguucuggucuugucuugacaugccacccauacccgcuugagucucagcugcuuguauucuaucuugucaggaaagucccgggguuugugugccauguaaggacaucucaguguuuucuuuuuccuuucagggacucguugcuuggugcccuuggugucaguugauuugauaccacagguugcuccuucucccugcucuguaagaucucacucagugccucuacacccccagcagagaaguguggggaugaguagagcgcuugccaaggaagccuaaagacugagcuaacucagcaucuaugucaaaagccaggaagguggcauaugcuugcaaucccugcacuggggaggcaggcuggauaggccagccaaccuagcaaaauugauaagcagcaggucccagugagagacccugccucaaaaauacaaggugauggcucuucugaaggcuaccauuugugguuuaccucucgucucugugcacaugcgcacaugugugagcgauggcacacagagagagccggggacggggagggagcaggcagugcauguauggggacuuuggcuugaguuggaagucuggggccuuggcugaaguugcacgccagccccagcugcccuguucugcacugugcuccagcaggcaggaacacuugcagauggaagucuggagugaggugugucuuuccucuugguccugcauugacuuaguagcucuuucuaguuccuugucauuaggucaugcuuuggacugaccaaacuaucaaauacaacacauggauuucagauagccuaaagauggagaagaggacacacccaauaugugcccacuuggcuguggauucucagcagcgggcuugucuguauuuaagacccgcuggcauuucaagguugccaccagaagauggaucucacagggugaugguuaacuguggaaaggugcuggugacagcuguagacuguguccuaucccuucauaccuuucccaaagauaacugcuaguuucuuccacacccgcagggugcuugcuauguuugucugugugguuuauaauugccuugccuggaggagagcacuuccuuguaugcugggagaaaucccccagacuccuaggaaggacuucaggcugacagcaaccagggcuccagaugauauucuuccagauaacagcuucucuucgaccucagguggucaaggugccuucccaugggaaugaacacaguuaccacuggcuuccucuccaccuucuguacaaggcuuucuggauccuuugagaggacuuguauuacuuggccaggccuacauggcagaaggaagccauucugaaguuaaagucugugggaggaagauguuuucccuucauggcccuguccugccucuuucaucccccuuggccuccugcugagcaggcucugguguggucccuguggguuuuucucucccuuccuaucucuccuuuccuugaguccugguuucugccaaaacugaccugagcuuguauuuguagucuuugagguaggaauucuggugugacugccugugcuaggauuuggaguugaagaaauuagggggaaaaauuacaguugauuugcuuuagcugagagggaccagggaggccacccaggagaacgcucucacugugacguagaggaacaccagucugagggcccugccugugcuuguguagcuugccucugccuuugugcacuguccugacauugaagaucaccaaggaugaggaaggcuucccggcucccagcagacggauccugugugagccaugugugagauggucaaugaguuccuggguuccauagaguaagaaccuuccaggacccuagcauggcucuaaacucaguugaacuugacauguuggcagacugacuccuuccagcaugggucugucuaaucccacggguccaguaacuauacucagaggguucuaccuguuugaaugcucugcaguuaccgccuugagauucguaaucuuuggaacaaaagcuucauuuucauuuugcccuggucccugcagaagaugaaaccagucuugaaugugggucaccgcacuaaaugccaagcauuugaucaaucuguacuugcgacugauuugaauuuggggaacaggccguuccccgggaauaaagaaggauucauuucuuuucccucgaauacacuguguucuguuuuccaaauuugcugugcaucucaacucugcagauaaauuagauggcuggauggauuguucuugcuggaagcaaaggcugggccguuggacuugcauccuguccccgaucuuucaguccggaagugcgaaucaggaucccacaguggugugggauguagggagcugaaaaccgaggcugagaagggaggcugcagauagcagagauugagcugagagucucugcauggcccagcuuccugcugugccacucgccagcucggaggcuuuaugagggaaggcagggagcagguauggaaccuccuguagcccaggcuggccucagacuugaugaugacuaaggucuaggaugaccuuggacuucgaauucuccuguccuuaucuccuaagcacuggaguuacaggugcagucccccaugccuggauuacugugugcuaccagggauggaacccagggcuucaucuguaccaggcaaacacucuuauuaguugagccacauccuuaguccaguucugggccuaugaaccacacacuuuccugcuguauagauucaagcauaagggccacccugaaggcuuugaggaaaaacuagaggaaacaucugugucuagcauuguguuuaagcucacagucuuauuggcuaguaucgccuaguauuuuacugccaauauugaaggcugagcagcaucugacuggcuguugggaagaauaaaguguuccaggcaggaagcaaaaugguugugaguacagagagagggcuggaguguuuuagggauuccacgggcaccguguuuuggggacugagagggaggagacugaaguucuuagaagauucugaagcacaggacgagcccuaggggguuguugcgaggcacuggccgcagaguugggcuaagcaggagccuggagaugaucgcagagacuucgggcugagccgcucucugugcaguacgucacuuaggauagcugccauaugacagaaggauagagccuguggcaucuguuaguguuuuuggucacugugacaaaacacuugguaugaauaacauaaggggggcuggugagauggcucaguggguaagagcacccgacugcucuuccgaaggucuggaguucaaaucccagcaaccacaugguggcucacaaccaucuguaacgagaucugacucccucuucuggagugucugaagacagcuacaguguacuuacauauaauaaauaaauaaauaaauaaauaaauaaauaaaaggcaaaauaaaaaaaaaagaauaacauaagggaggaaagcggguuuguuccguuuugguuuuuagacaaggcuuuaggaauccaagcuagcguuggacucaguauuauagccaaggaugacuugaguuucuaguccuucugccucugugcaauccugagaguaccagcuauuguaccccguaacuuaggacuaccuucaugucaggcaagcagucuggcaacugagcuacgucuccguugccaagggagggaagauuuaugguuaacuggcuccauuucagugggcuugugaggcacuuggaggaacugguggcagaggggucugcucaucucaugccugcugaggaggggauggcuccagggaauggagggaggggaaaaguaaagagcuagagaccagacaccuuucuuaaaaaagaugcacccagugaucuccucucaaccagguccaaucugcuaccuccuagugaugucaucagugauuaugucaucagugauuaugucaucaguggauuaugucaucagugauuaugucaucagugauuaugucaucagugauuaugucaucagugauuaugucaucagugauuaugucaucagugauuaugucaucaguggguuagcccauuggggaagccagagucuuucagugauuggauccaucaacagucagagaucaagucuucaacauaaaagccuauggcgggguuacaucacguccaacccuauagcuugucugugcuacuuuguggguucuucuuuuuccccacccuuuauccccccacaccccuauguuucaccccuaucacuagauaggagaaaaugaaggauagagggggagagagagaaagauucuugaaucuaauuucuuucuuuuucuuuuuucuuuucuuuucuuuuuuuuuaaagauuuauuuacuuauuuuauguagaugaguacaccauugcugucuucagacacaccagaagagggcaucagauccaauuacagaugguugugagccaccaagugguugcuggaaauugaacucaggaccucuggaagagccgucagugcucuuaacugcugagucaucucucuagccugaauuuaauuucuuuuauuuuuuuuucuuugaacacagcuacuaacacaccucaaacaacuccccccacccccaacaaccaucaaccaccaacccugucuauugagacucuaguauuuauauacugucugaaaaguucccagaauuccaaaugucacacuauugcagaaacuagcugcagcuggcaaaaccacaccucugcuagagcacgaggcaaaucauagucagcugcugugggcaaucagaagcagccucauauccccacaccuggaauuaaaacgaaaagauauucuuagaauauuucuguguuugaaaaagaagccaaaguucuagaguuauuacuauacagcccaugauauuaaagcaacugcagcuaaugaaagguuuuaucucuguaaguuucccacauguuaaugcuuugcuacagcucuugccugagacaggagaccuuauuuggcugacuuucacuauacauugucucugcucuguaucuuucacacugauguagggauucaguagcaucagaggucccagacugucuuggcacauccucuccuuccaucacaguaucacaguguuucaugacauucccagucccaaagaacaccaaagaguuccauuugucaagcaguguuauacaaacaacuugucuguguccuuacagcaugguaggcauuagggaaaaacaauuaccuuucacucacuuccccuuagcacuguuugcuaugaauagaacacacacacacacacacacacacacacacacacacacacacacacacacaccccuaccucuuuggugacuuuccugguuagcuucagguauccacaguuaccugagggagucuuacuugggagauuaguagucaaauugguuuauggggcauuuucuuaauugcuaacugauacaggaccacccauccacugugggcaauaccauuccuaggcaagggguccuggacuguguaaggaagcuaggaagaacaugccaguaaccaguguccuuccaugguuuuuucuugaguccugcucugaucuccuugaaugauggauuggaacucuaagaugagauaaaccauuuccuccucaaguugcuuuugguugugguauuuaaucacaacaggaaaacaaacaagacuagcgacacuugacccuuccaguauuacagacaaauugaguacgacuuccaccauuaccaguguugacuaauuuuucuguaaucuguuccuuuuaucaaagcaacugccagcagccuuaccuuguagagauagggggucauccaaggaauguggugacacaaaguuuuaaaacugucuucucuucuccuuucauauauauauauauauauauauauauauauauauauaugcaugaaaaacacuuugcccuucccuuaagugaaggaauguaucuacagauuuggacaucugcugaggaccuggaaaccccuucaucccccaucauugcugagggucagguugcuaaaccaggggcccuguucuuuccaguaagcauucuguaaugggaacuguguguuucucucuuugcuccuaaaaggaaguuguuguaaguggcuaauuaaaaaagggaauggauggugcauacuuuaaauuaaucacagcacucaggaggcagaggcaaccuuaucucuaugaguuugaggucagccugaucuacacagugaguuccaggacagccauggcuaugaagagagaccuugccuaaaaaaauaaaaaaaaaaaaaaauaagagaaagugguugauaauacugucuguaaacccccagagaugaugacuuacuuuuaaggguucaacauuuaugaaguggugugccuauuaguuuauaacggagaaaggcagaccauugcuuuuuaggauugaauucuggcagccaugagcucauaaagcuauaagaaauuguuggcuguacuuaaugggccauuuguuguguuaaaaucaguaauacuaaauauuuauuagccaaguggaaagauuuaucucuguaaauugcugugacucaucuuuccgcuugcugauucugguuauuuagauuauuuuuguuuaaaaaugaaguccuguuguaagccauucaguguuuccugucugagacuugcuauguauaauaccagucuuuaauguugacauacauuuuagaaguagguuaucauuuucuacuaaaacuccuuagguuuucuauggauguguauuuuaaucuacacauccacuggggggaauugaaaacuuagcagcauugagccccaagacugcaggucugguauuuuucugcauuuaagucucauuuaacuuguuuuggagcauucaagggacaguucuuacacaaccuuguacuauuuuccccaaguauuuuuuaaauacuuuugaugucauuaugguauuuguaaguuuuuugcuauaauuguuuauugcuaaauacacaaaaucuaauggauucuguguauugaccuguuuuccuacggcaccacuaaauucacuucuccuggcauuuuauuuuuauauuccuaagaguuuucuagaaagaccaucauaucauuugcaaauaaaggcagucuuuauguuuuccuuucuaaccuccaugauucuaauuuuccucucuugccucuuuguaugugggccauugccacagggcagccaguuccagcucugugaucgguauagccauggaacaauaagaaagggccaggcucagccccacagucuuucaucuuuguaacuugcaggcuaagggagcaaggcgggauggggaguggggaguggggguggggucaugcuccuggacuugccuucugaugggucuuuccauugcggucgagugcccaucuggguuacaguuugggcucgaucacauacugaccucuggccucuucugcaaagcugugggggguaacuuugugagccaggaaauggguaccgguugugaucagaaaaaugagccuguucucacaucuacccaucagccagugcagcaguggccauagugaugcuguuggaagcuccagaacuacuugaguuugcauagguugcaccucggccuuccuccucucccuguuguuucauugauguccaaagcacucgcaucugccagagucuccugaccagccauucucuccuuaaacuauacucuguggcuucaucagguccucccugggaugggcucuucauucucauccuguaaagcaagcacuaagcccugugcucuuauccucacauucuuuucugacaagggauuaagcauagaggaguagagucuggugauguggcugaggccacacaguagugggugcggugcccagagcuauaagugaccaucagagaucagagcuaguguuugguguucuucccuugaugagggcucuggaugcagcuuugguagagccagccuggcuucaccuauggagugggugucuuuguguggguugaccauucuauaaagaggucagaagcagggccaccagagugucugcggacacaaggaggcuguaacagucacccccuccggauaagugaaacagggcagggccccuaauuugcugccuuuacaucuaaagaugcucugaaaguacaggugcagaaaucacgagucucuucucuuuggguugacacuuugucgaucuuugagcaauuagugggcaucccugugcauaguuucucuguggaugucuacuaggugauagcgguggaagucagcagcuagcuugucacuguccucuucccugcuccuucugccccaacuagccaauggacgagcccuguaucaaucuccagagccacauacccuguuuugaugccuccugucaugcuaauaggacauggagacuaaccuguggacugaggaugggccucagccuucacgugccuaggccagauccuucuuuguagcuuucuugguggaccgacguuggagcugcuuugccuucugugucugagaaagguaccugcuucucauuggagccuguaaaucccaaauuuauguucaccccggugugggcagaucaucuuaagccuauuucagcacaccagaaagaagaagaagacaugaguuaauuauucuucaaggcaggaaucucacagcuggugguuucagaauaccacgagcccucugguugggagccagcuggaguuaaaccucuacuugguccuugucccaggaagcccagauacacuuguuuacagcugucucucagugauguuugccagacucugcucaggaggaacguuuccacugccauagugcguucugucuuucauuuggguguucagggggacgcgccuauucaucacaacucccuaggaaccugggagaacuguggugguuugaaugauuucccccaccccacccccacccgggaugcucugguauuuagcacuugguucucaguugcugacugugcuugggaaagcuuaggugguauaggcuugcuggaggaaguacugucacugggggaacgucaccggggguaggcuuugagcuucccagcacucccaguuugcucucucugguuuguacuugugguuaaggauaugagcucuuaguuuccuguuucugccuccaccaccauagugaacucuuaucucccuggaguguaaucccaaauacacguuuccuucuaagaguuaaaagagccuuggucauggcagcuuuucacagcagcagaaaguaacggaugcagcucugugugaugccucugcagaaguggaaaugggaugcauuagaugaaacuacagccucggggguggaucccagaucuuccuguuauuuacgugugucauuaagaccauuuaguauccauggagaaauccuggccucaguuuccccaaauauagcaugguagcaaugcucauuuucaaagucugcaacaaaguagaaaauuaaaaggcugugaaagcagacuuaauaaggugauucugccauggauuugucaaguugguuugucucccuaaaaguugcaguccuuucccugaaccugggaacaucaucacaccaugggaaaagagaucagaguuuguggcuguaucaagcagcuucggguggggaacugggcggauggaggcucccuuccuuucaguauaggaagcuggucccugcaugucccugugcucaguugcauccaguuggaguccugcagacccugauagaacaagaauaagucacagaugcccuggagcuuuugggggagccuggggacaugcagcugugaugggucacaagaggacuggaaaggucccaguucuuacacaaagcccagagccuagggaaugauuccccuuccacagagaggcgcgcgcgcacaugugugcgugcaugcgugcauuuauguaugugugugcaugugcagauguguguaugcgugcauaugcuuguuaugugugauuacauaaaugcgaauauguguccauaugcucauguauguucuacacaugugaguauacacacauauauggaagugcuuguauguguaugaguuugugugcuugaguuagucugcaugucuguaaguguguguugaugcuuuaaugcauuuuuggcucccucuaucccacgucuuguuccaggccucagcacaggcucaguagcacuaaacugucucaucucugccuuuguccucagggcaggaagaucccaacaguuugcgucauaaguacaacuuuauugcugaugugguggagaagaucgccccggcugugguucacauugaacuauaucgcaaguaaagaggccugcccuguucccucacuaagaaauagcacuagagcugcuucugaagcacauuaaagugucaggaaugucacugggcagauucuuggguuacgaucaaguucucugccuuagggaaaguucccuauuuagaccuauaaucuuggcccuuucagcauuuuaauaacuucuagcucugaagugauucccagggaauauuuccuaaguggaauauuuuuugaugcauuccaaaaaguagcuuagcguuauuuuuaaaauguuaaaugcuugcuacaaugugugugaguugcucuugcagagucauucccuugugugugcaaaugaguucaagcucaacuaaugucuguuucaggcuuccuuucucgaagagggaggugccaguggccagugggucaggauucaucguaucggaggauggacugauugugacaaaugcucacguggucaccaacaaaaaccgggucaagguugagcugaagaauggagcuaccuaugaagccaaaaucaaggauguggaugaaaaggcggacauugcgcuuaucaagauugaccaccaggugagacgcaucuggggcccgagugccuccugggccugcagugcccagcucucagaaggugagguggagauggugaggacaucagagcucccugguacccacaaaaugaagcugcagggccagacaggucucaucaaagagggaccugagcaggggaaaagggaggagggggggagggaggagggaagcccuuggaagaagcuggcucucagaucagagguuuuaaaagcagcaucuucucuuuauaaagcaacaggcuacaaagaacuuaauggguggcuggugagaauggaaacuccaauccuugaugaugaagcaucuauuacaaaguuauguuugucuccacugaggugaccuggauucuccauggcuacagaaugggcuuugaaaagaguuuuaaaaauugucuuuaauuauguguuguguggguaaauggguaugcaccgagagauguuggauacccuugccuagaguuacaggguuaugggccacuagacaaugggucucugcaaaagcaguaugcucucuuaacgccaagccaucucuccuuguuaagcacuuguuuguuuauuguauguauaugagugcacugucgcugucuccagacacaccauuccaggugucccauuacaggugauugugagccaccgugugguugcugggaauugaacucaggaccucuggaaaagcagucagugcuguuaaccacggagccaucucuccaggucaagguuuugggaaccuuaagacaaaauuaacaccucucucuugagacccuaagaauccuuaauauuaugacaugaccauaguccccucaaaagggcugcaaugcauuaucuacccaaauuauagccuuccauuagccuguaacucagaagcagggccaguacaaaacuaagacacaguaagagugagcucaauuugaaaaaugcuuaugugaaguugcucugcgaguuauuggaguagcuacuucuaguccuaccugaauuuuauuuuaucuuauuuuauuuuauuuuuggauauuuuugagacaaggucuuaaguucuagcugucuucgaacuuacuuuguaaaccaggcuggccuugaccucaaagagauccuccugacuuugccucccaagugcuaccacaccaacagcaauuuuuuauuaaagaaaaugaaagaaaauguuuuuaauuuaauauucugcuuacagucacauuugcuuagcgaagucuuuguugucuuaggucucauguggcacagggugccuucaaacacaucuauuaucuguggauggcuuugaaccuuugacuccccugcaucuaccuucuguaugugaggguuauggacauguaggaccaagccagguuuauauaauauuguggaucaagccagggcuuugugagagcuagccaaguacucugccacaucucccacacuuguuuagcaaggccuucaugccugaaacuacauacaguucuuacuggaucaccagcaaacguucccaguccaccucauguagaucacauggugaugugagguugguuugcacucaugcugagacuggaguuucuguuuucuuccuguuauuggaaauuccuucagauaaaaggcagaagggucagugggaauuuugugguuggugcagaaaaaggugugagugggguggguaaugaaguguagccuuuucuugugacuucuugcuugcuucucaucugacugugagcuaugaagucagcuaggugugaaguccuacuguguguuccagcuauuggauggagaaagcucaggguacuauuggggcaguaggauucuggguccuuuuaucuccuuuaaaauagcauuaggcagcuguucagaaucuccccccauacccugcuugucuccuuaccuucucagaggcugggguggugagggcuggggcugaagguuguagauacaggcucugugcccauguaggugacaacugaccucagggucacaguuguguguuauuucuguuaaguuacugugaaauuucuaucaagagcucaucuuucuaaauguguuuauugauaccaagacaguugguccaggcucugacuucucaucuaaccauucuuuaguauauagaguagccguguuauucccauuuuauaaaagaagagggcuggugagauggcucagcgguuaagagcaccgacugcucuuccaaagguccugaguucaaaucccagcaagcacaugguggcucacaaccauccguaacaaaaaucugaugcccucuucuagaguaucugaagauagcuacaguguacacauauaauaaauaaauaaaucuuuuaaaaauguauuuuaaaagaagaaagaaugcucagagaccacuccuccaucuuaucacccuuagccuccucagagccaggcugcagauuccagguaccuaacuccauagccauuagcacagggacaaagccuggccuucacaugggauggaguagccugaccuuaaauagcccauggaaagguugguguguccccuuuuaggaaugcugcuagcaaggugucuagaauucgguggaggcaccggaaggagauuggccagaauagcacagucagugaccacauguaggaccuucagacucaguucuuggaaggcagccagcacugggggccuccuggccaucugcaggcagggcucuggccugugugguuugugagcugucuccucaaguaauuucauguuuggaaugcgugggugcauaccacgugauugcuuccaguccagggauauucuuuucugauuuugagccaauguggagacaggagaagccucaugucaccucuggcauaaccaagcaaaaugugaaggcauucccugagugucuagcucuuuaaccagaagccugcuguuugacauguacugcacgaacaacccccaccccccaccauguuuggaaauguaaaauugaccugauguagcuuuugaaaauggaguuggaaaugcaaggcuauuacauugcagacacccacaucaaagccugauuccugccugcccccaaccccugccaccccucuuuccuguuugucccuguucuggugagaguuauucuagggagagucuggcuuguaacaaagcuugauuuggaaggaacaggcuggccauccaguugaauuguguucgagcagaauuuaccccauagugugugguaugaucaaggugcguggugggcagugaugggcuaggcacuugcuuggcguugcgucguccuaggggcagcaaccaaggaacaggucagggaaggucagagaaggcagaguaggauugugggugugguggugcauacccacaguccuagcauuugagggaggcgggugugaagguaggaagaggagacaggagcuuaagcccagugacuaauucaaggguuggccaucuaggcccaguuuccuaucagcaugaguugucugugacucacacuguccuuuuuugugaaauggaaggugcaaugggcaugcaaugucauuguucacuugauuuuuaucccaccugcccccaccuuuuuuauuuuuuuuucugagaucaccagccaucuuuuuuugggggcagauccaccauuggggagcuuggggguuggggguggggaaguuguccuaugccacagggccucgacccgcauggcccaaguguggugagcgcaugcuaccccuuagaaucgcaaaccacugauggaugcugcucaaggaaaggacacaucgcguaaggccucuguaaucaccgccacagagcaggcccuucccaaguuccuucacuucaucccucucacagagaugcuucacaucucuaagggauuggagcugcuuggcuugcaauugccagagagcuuucugggcuugugaccaaaagccucucuuuuguuucucugcugagcggacacaugcgcaugcacucugccugcugcauuuugaggcucugaagaacucagugggaaaggcucacacaggguagccaucugugguugggacuccuccuguuccacccccuggaggggagaggaugaccccuacaggucucaugggauucuccuguccucgagcugaagcuaaggguccucaguggggucaguauugaucuggagguggggguggggcucacacauguaaauauuuuaauggaaagcagcuuugagggcaaacuaguucagucugagaugcaaacuauuuccaaauguguuugacucgagccacuggcccuguguacagaauauuuuuaacuuuaauccaaaggcaguuuuugucucucucucucucucucucucucucucucucucucucucucucucucucucucucucucucucucucucuccuuccugagcaguuuaagaagaggagagagccucaagagauggaggaaauguaaaaugucaaccuaucagguguccugagucuggagcagaggcaugggcagagagauggggaaguguucagaaagcaccagggaaaugucgucacgcagcuguuuuuccagcuguuguacugauuccuccagaugcugucucaccuaugcuggagaaauccuuucuuucacagcagccguucucaaacuauggguugcaaaccccuugggggucgcauagcagauauuuacauuaggauucauaacaguagcaaaauuauagcuacgaaguagcaaugaaaugacuuuaugguugaugggucaccacaacacgaggaacuguauuaaagggucguagcuuuaggaagguugagaacuacuguuucagagugucuugacaacuccuuccugagacccacccgcucgaucuguagccccuucccucguccuccuaccccucaccaucucugcacagcuccuugagguuuagagugcucuuucugccuggccuucccuuguccuucagggaugcagucacauccugcuuuagaccccagggacaucccuugccugacucacugcauaaaauaguuucccacaucugagucccccucacgcuccagcccccccccccaucguucugcauuugcccuccuuccucauuuaaauaagaauuuguugcuacuuguugcuguuuaauuuuucauuauuuguguguguguguguguguguguguguguuuguguuaauaugcugcucagagaagccucaaacugcugggcucaaguaauccucccguuucagcuuccuacauaccuaggauuucaggcaugugacccuguaccuugcugcccuugauuuugauuucucuaucucuaucucuccccgucucuccgucucugugucugcuuucuaucucucccuguuuaggugacagcugcuuuccaccuuacucucugagacaugguuaccugucaaaccuggagcuuauugacgugguuagagcaagcuccaaggaucccuuuagcuccagccgccccgugcugggaucacaggugugccuggcuuuccauggccucagagaaucaaacuuaggucggcaagcuugugcaggaagcacuucacugacugagccaccuccccagcacuuccucuguguucagacuccacaucaacugcuagaguauaaaggacacauuucuuuuggccuucaggucaggucuuggguacuggauagcuaugcuggccagucuuaggucaaguugacacacaagcuagaauuaucuggaaggaaggaaucuuaguugagaaaauaccuccauaagacccagcuguaagacauugucuuaaucaguuauugacggaggagggcccagcccacugugcauggggccguccccaagccuggguucuauaagcaagccaugaggaauaagccaguaagcagcaucccuccaugggccucugcaucagcuccugccuccaggcuccuccccugagugaguuggacuuccuucgaugaugagcagugauauggaagcguaagccaaauaaaccuuuuccuccccaacuugcuuuuuggucgggguguagaacauggacaauugaaacccugauggagagacagcaucugcucggagauuagccaggugaucauggcuauaguguuccucugaaacagcuucagauaaagagggcugugcagcagacugacugugcacucuugucucccacuguuggcuuuggccagauacagcccgagccaggguuacacugagccuguggucuugguaccucugagugcugaggaagcaaggagagacuuccuguggguucuuuucccugacgccaaccaccagguaaauauuuggacacagccuuuaucccagccugagguggcuuucuuucuccccucaggccuaccaauguagguaggugccuggcuggccaccuuugucccaccagucccacagaccuguuugaaguggcugaggcauagccucugagugccguuguuuuugcuuacugaggcuccucuuacugcugagccugcugagagggccugaagucugaugcuucaccucagaguucagagcagggucacuuagggggcuguggggacugggacuuucauaucgaaaccucccaugauuuggcccugccuguggagagucagccccugguggccggcugcuggagaugacucacucggguucuccucaggccacuugacugucagaggaugcugacuaagcccaugggcucuuccaaaagcaaaucagauaaaccaaagccugugcauccucuggaugcuguccucuucccguaaagcagccugcagccuggaguaggccacacugccccggaccuuccuaucuggcugucgugaauguccacuggcgcuuguacccguccauuuuggaugcuuucugggcuuuggcuugcuguacuuuucuguggucuucucucucagaacuaggagggcuucugcugcaguugucagagaugcccgagagucugugcaaagcuccuguuaccagauugauuuuuuacuuuuuaaauagggaggugagcaucaauauuucaggaagaagugcagacugggauguggggaugcggaagguggcuuuuauucugcagcgcagguccucaauccagaggcgaacggccgcagagccccuuauuguucugauuguagucauuuuggcaugugaaaauguuucacuuccccaaacucagaacuggagcccuguguguucucuggacccauuucaagaacuucacugaugguugaggaaauucuuuggcucuauuuuucucuuaauauggcaaugccuuuuuuuucccucucuggcacccuuugcagggaaucagaaggaggauaugaugguucaggcaaagcaagucucaggucacugggagucucuccuguccuucucaucuggggggggggggcguguugcagaaugggauuuauuugacuguugugagcaugccuguguguuagucuagauuggccaucgguauccucuugccauaucuaauccccaucuuuuuuuuauuguaaacaguuuuaucagaacacacccaugacuguucauuuauauagucuauggcugcuuuuauucuguuccaaagaaguugcauacuuggccuggagaccauauggcaagggaagccagacauuugguuuccagugcuuccuagugagaguuaaccagcacuaguaacagauagaaucuuuguucugggggagaggcaagggucugggaagaacgugugaaauagcacacagcucagugaaacaccaagggaccagaagaagugagggccguguagcuagcugacuucauuugucuuucuucugggaggaguuugccuauguuagaaugaggcuuugguuuugccggacugagcagagagaggccuuaagucucucauuucucugcgguguugguaaacaggacuuuacuagaauuauacgauguuuccagguuacuauccaacuuuaagcccaccuucauuugcuuguguuguauaugcuauugaacaccugccuuggccagacauuguuagauuugcuuagacaucuaagguaaacugagguggggcguagaguuggugacccggcacuuuucucugaaacaaagcuugauuuuguagggcuggcaagaagcucccuggggcugccaaagagggggaggggaaucagguaugcaugcucauacauggugggugaagcaaguuucaacaagcuccaaccacuuuacauauacacauacauacauacauacauacauacacacaguuaguggauggagcacaguuccaaacaacuuuacauauacauauauucacauauacacauauucauauauacauauauacacuuacacaugucugcacagguagcaauagugggcgcaagucauggagcugaagauuagugugcaagacaggagugaaauggagaggagacagaggggaaaaggggcaagagccugccugaggcuggaaggcuucugcaaauggaguuuauuugcagaagggacaguugguuggucggaguugaggugccuugagccagccuuggggacaggugggaaaugacuagugaagcuuuuuaauucuccuuuucugccuagccuggaugaucuguaucucagacuacggcaaacaggcauuuuccagccacuuuaugauaacuuguaaaucacaaggccaguguuucucauuagcugcuaucucuuuguauugucuaagugucuugcuggccuacuccucuucugggaacuuccaaggccuuuuagacacucaauuuccagagaggcucagaaugaaaaggauucuuaauuaucuggacguagaacacaguuuccccuaauugauugcuaaaucuccagaccucuauggucauggaaagguaacaccuugugguggauugaggacugauuguuguacuaaacccacugauugacaagacacuaguuaaaacaggacacugaaaucucagagcaaguacacuuuaaagagaauugcaaaccaagacauuucaggucaguuaccauggccaagaugcuaggccuuagcuaauaugaggauugccccacucccaccccccauuuccuugcuaagagucuaacggaucuuuuaagcucauccauugauuuuucuaaauauuuauugagcauuugccaugacgggacacugcugcagcagccaugcugaggucgguggucaaacggguugauguagcuggauuugaucaacauccuguuucuucuccugugggugccacagaauauguauggcuguuggcucccauauagagcuguugacauuuuguggucuagaacagagcaagaggauauuugaaaucgugaacauuucuugauauagcucacaggaagacuaaauauuauggugguguucauaaacagugaggaggaaggagguugcacuucagcguuuacauuccuucucuccuuuugccuccuguguucuucuccucccaucuucaucgcucucaguucuuccaucucccuuccaaccagcuucucauguguccugcaucccuagacaccaauaacauguccaaugaggaaaggguugcuggugacaccaaccucacgagccuguauacauugguagucguaguacccauggagcaggucccuccugcccuagccucucagcuccuagguugcaucuuuccguucaucacagccauccuugacucugucaagguucuacacuugaccaugcugccauucauagccucuuccuuaauugaaauucuaggugucucacucuuuguccacuuggcagaugacuuuguuggcacgugauuugugcuuuuauaacccauggacucagagaggucuuauguucugaggccacugucccaauuugaucuuugaauuugugucuuguccuagauucucaaugggacaguggugugugcucagugggcuuggagucuuggcucggguaauucuugcuccucauuccuccucaggauagcuccuggucuucccaguacugugcuacagggagcucugaccuugccugucccccucgccugucuguguagugauuguaauuauggcccaugccuagaagacaucccgugcccaaaagaggcaugggccuuggggguacugucacacuucacagaucuuagggcugggaguuaugcaggacuuggggugacagacuaauggcaugccccauggaucaccaggcaagggaaagcuucugcucuggucuagguacccaacacaaucccauagauaugcauagagguaguaaugccaaagcccuugaggucauccaucaucucuggguugagccuugggaaggagagaugccaggcuuuucuuccuuauuccaguugguaccguguggagauacauagccgguggcagagcacuggguuugaggccaauugggugucugcacuugccaaucugggaauuuuuuuguucuccaaggaccaaagauaauacagaacauuaagaaguggggagagcauguauuaaacaagaaaagauccuaugaacccggggccauguuuuauuucacauugccuugcaaaugcuauaccugguccucagcaaagcuuuggcucacuugauucuacagcccaugguuguaccaaccuugcuggucaugugccagaacacucuccccucucucuuauaagcaaguucuuggaugauaacauccccuuuccccaaacccccucugcuuucuucuuucuggguagggggccgguguacacaguucucccuacugcauaguuuuaaagaguacgagugguugacauaacuguuuccagaagacauguugaaucacucaguugaguugcagccaguggcugcaacauuagccuuugaugaaaacuucggccaacaugaggcccagccugaaagucccagcccuaaacaggagugugccgggcgggcagcuggcagacacagagaacugcaggcucagcaacaaaaauauuuuugcaaccgaggaaccugucguacuucuccaaggagaaaaagagaugaucgacuuggcucauuagguuaaaaaaagaugggcaacuuucccuucauuuugguuuugucgguucauuucauuacucuugucuuuaaacuucagggaaugaggugagugcauggccugguagugacagcugagcuggcgaagggacuuggcuuucugcuguccuugcugaaggaugacuggucaaacaaccaccucacgaguuccagacaucuguccacuugauguuugagaugcugcagcgaucuugagaccuugauggagaguugugugcaauuugaggcucccccuuaccuuucugguuucacccauuuaacuacugcuaaugggauuuucagcaacgaccacauauggaaagagcccuaaucaucaugacugacucuagacucaacuccuuuuuuucuuggaggaaguaguaaaauccagggaaaucaaucaaguaacagacugaguuaauauaagagccaggagcagagagauagcucaguagggaaaggcacuugccacagaagccuaaugaucugacuuggauuccagagcccacgugaagguagaaggagagaacugacuccacaaagauguccucugaccaacauauauguccugucacacgcgugugcgcgcacacacacacaaauaauaaaaauuuaaaaauacaggauuccacccaaaccaagaugucgguucuccuguaaauauguaacacacuagaaguaugugugccugugagcguguuuugauuaaucuuucuuuggcaccagcuuguuugauguuagaccucaagcccaaaugagccaucccuuagcagggucuccauuuuccugcucuguggaguucuggcaguuauaguucauccucuguucacuaaugaagccuacagcacaugacacccugaagccaaggccaagcuuaccagaugaagaaagauucucccaaagauaccaugggguaagcagcaaggccagcucuuuauuugagaaccgcuagcccagccccuguuggcugguccaucugaugguuuuguuuuuuaauguccuugugauagggauagaacacgaggucucgcccaugcuagauaagacuaccacugagcuccaccuagucucugucaugguucuuaaacuccucugacauugcucuguucuguuacaccggcggcugacugcuccccucugugcauagaccauuccuucccuccuuggucagcuuugugcucugaacaucugcauuguccugcagacacaauuccugugcagcaaagcaggaggaagcacgcacuugugugaggugagcccagagugagcuuaucuccuguggccgggcuucgcuccgucaccugcaucuucacucagcugagacacgugcugcagcccagaucuugugggaccuuucauggggauggaacucgguugcuuucaccuggugagcugccuuacugguucucucugugcuucugaggagucauggugcuaaagggcgccuugucuuuguguggugucuguagugguggcggcugccuucugacugagcgagcgagcacgcgaaguugauggagaagagaggaggaugcgcuuggaccuuaauguuguccuucagcuuuugaagccuggccacaacacauggcugugacugguuuggauuuggcuucauguucccugcacgugagacacacacagagccuuacaguauaauucugggcugguauuauagacaguccugugcccaguugcccgcagcaagggggugggcuccuuuccucuucccucuugagccccggugguucauccgugcucugcccaccagacaggaaaccuggggagcuggacuggguauguugcuccuugaaguccuaugccaggcacugggaagacaauuuguugagacugucccccucucagguccuggggguaaagcuucugggccugcuuggccugguggugauaaguuaaccaaccaggaagaccuuuuuagaaccauucuauggaccaagcccucaacuuacuucauaauuaacaaccagcuauggcugguguuuaguaauuuaugaggauacuggaagccuggacucuauguccagagucacugacacugucccuugggcucauucucuaccuacucaggugacgcugugcuuauaacuugggaauuaugauuuuuuucuucuuaaguugugguguguggcaugcagguuccuaugcauaugugugcaaguguguauauggacaacuuuuuggcgccucuucuuaucuuuuaccuugugguggcuugaaugaaaauggcccccuguggagagggucacuauuggaaauguggcauagguguggccuuguuggaaggagugugucacagaggguggcuucugagauuucagaaacucaagccaggcccagugucacucucuuccugcugucugcugauccagauguagaacucuuagccaacuuuccaguaccaugucugcuuaccuaccaccaugcuuccuaccaugaugauaauggacuaaaccagccccagguaauuuuauuuuuacauauguauauauaagaguugcccggggcguggugucuuuucacagcaauagaaacuuaagacacaccuuguugaagaucucucuuguuucugccacuggcuugcauguaauuauccaggcuaacuggucuuuaagacgaugcuguaucuccuguuucugucucccaucuuaaaguaggagauagguggcacuguguguggcuuuuuucuuuuuuuaauuagguuucuaagaguagaacucagaucaucuggcugccuggaggagccaucuucccggcacuaggaauucuucucuuucucuagucucucucaugacuuugaugauacuauuuagcaugaggcagugcccugaagauauggugguuauacaucuuccuucuucauagcuuucucuucugcuggccucucaggcugcuguuucucuucagccuggugagaacucccugugagagagugaccguaucuuccacauccuacagagcugcuggcccuccugauagaggcggagggcuccuucuuggcuuuaggauauggaaccucagagccauuuuuccugacuucaucucaugacuuuauuaugcuuacaaauugccuuuucgcaucuccucagcuuugaggccagcaggaguggcgggugggucccuuccuucuccucagccuuugcaacugucaggaccguuguuugucccguuuacuucuucggggagcuuugaauugauggauggggggaugugggacggggcuguugggaaaagaguuggucucuuggauggacuaugguuggcauugcuucaaagggagccccagacagagcgucugcagccaggagccuggagacggcuuugaugugggcucacggggaagcagccugcggacacagagcagggacccugaaguguggcagggugcccgcaaggucaaggcugcagcguggcugugccuuccagccuuguacauauauuucaucuccucuguccccccccaagagugugacugucuagacagggauagaauuaaaagcucaauuacugagcaggaauuuggccagugaaagcuuagcuaccgagcagacaggccugggugaggauuauggcagagaaugagccccauuuuggaccuaaguaaggcuagcaagccugaggcucacggccagccagcaccugcagggagcaagggccagaagggccccucaaggcagcuugaccucauggaguuguaaaucuggcuuggcagccaccuccgcaccaccucacucucccauacagggauuucugccuauaauuggaguccggcaauuagaauuccugccuuauggggauggaggccuguggcugggaacugguucuccagcuuaaccaggcuucuuauggcugagagaagcucuuccaucuugagccucaguuucuauaucuguaaaaugguggguuugugugagugugaggguauguuauguccccaaaucaucagauugcucugaaagcacuuugucaucuggcagugaagguuuuguuccuuucauauaaauggagaauuucaacugugauaucccucuccugacccagcuacuaugugucugccuguuuagcuuucaugugcacagucacccuucaugauuuauaacauauauuuaaggagacaugcucaucgggacugcccaccugggcgggugugacagagugaucacacggcauccuuguggauucuuaucauugguugucccccuuguccaagcccaauauggacaccuuggugacaguggaugagaccauuguucuugagccuggcguguccucucaguguucaauagcauagaggccucugucuccugccauuguagaggucucugccaucuguccauauagcuuucucccaaacauuugucucccuucuagcauccgcugggccugagcucagacuugggacagaagcacuggacagggugucuaaaggcuguaugaguuaaaccugcaucucuggaucuccuccagaggcuguggcuggaggguguuacagccagaugcugauaaagauucucacaucggaucaccucagaccugauuuaauccccacuguguagcuggccccacugucccaugucuaagcuugacucuuaucuguguaguucugcuuccugggauguccagacugcccugcugcaggcuguagccgccucucuugccuguccuucacaguuauccccggagcuucaaagacaggacuuccagccagccccaggccccaaaggaaugguacuguccuggugggccucccccaguguggacagcacucaccagcagccagacucugccccacccugccaugauugcugaggucauucuuggcagagcuugcuggcagggauuguuggcauccacccaggacaaacaugucgugcugagcuugcugcgugccauuggauguugagugggucugcguagggaaugccauagacuccggccucaggugaccuuaaaguggaagggucauagccaguguggaacugugucuggcaaggugacauaccccuggcuugucacagcacaguugcuggaauccuucauuggauuuucagucauuugaauacuagucaauagcugacccacuggccaagcaggcuguuuccugagaggcauucaggcuccuaauucauuguuauccuaagucaucauccuaacagaccagugagauuagugggcugucuuaaucccacugaucagaugaggggcccaugcuugucaugcagaguuucaguuuggcagccuggccccagccccagauggcuggguuacccaucucaccaucccaccaucccaccaccacccacacuggcuuuuuuuuuuuuuuuuuuuuuuuguaauuuauucuuuuucaaggugaaugaguuucccuuaggcagccagcacuagccuuuuuuggacuuuaugagcaaugcauagaaaauucaggauuucuaggcuaugugggaggaagaaagcaggcccugggucauguuagugggagaaggcagcccguagcccuuuuccccagcccuucaaccuccaugguccuaucuuguucugaggaguuauuuagggcuccugacucugcccaguaucuagagggcacaggagaugggauguccucagcugaauccucagccugcauagucugggagcagguauagugauagggacuuucccagugugcacaagagagacaguccaccauuuggguccugggugcugccagccccucugcuugucccugugccucacaccacagggugcacaagaaaggcagugugagugucugccucagggcuccccacaucccaggccuuaggaaggcuaugugugugguaaaguagacccuugauuucuugauuccuccaaggcacaugggcucaggauuucugucugggauuuugaucuuuaagucuuaaaccuagguugucucuccauguucucuguccagaugcacagauguagaaacagucuaucaccuuuucccauuuuccuugguacaauugucuucuguuccauugacucgauaaugaccugugguguguggauuauaugguaggggcuugucccucaggagagggguguccaccccaagcucagcuccuagggaccgggacuguccuuuguauuuguauuauucagcuugcuaagccacagcuccguuugugcuuacagggaaagcugccaguccugcugcucggccgcuccucagagcugagaccuggagaauuuguaguugccauuggaagccccuuuucucuucaaaacacagucaccacugggaucgucagcaccacccagcgaggcggcaaagagcugggacuucggaacuccgauauggacuacauucagacagacgcuaucaucaaugugagcccucugcccccucuaccugcugggcuggggacaaguuucgagcagaggaagcugggcuucuucuuauucgcaaaccuucuuguagucugcaugauuucccagaacaucuaugauguucugguguuaggagaaaugucccacuuggggcuguacagaguugaacuaugggguucugaagugaguggguagccagucucauccgaggaggagguaaaaguggguuuagcuacucacaguggucucagaacuaaaucaucucacuguggcgcaucccgagcuuugugaaaaugguccagauccauuuucucaguuaaauauuaggugaucagagacaaagccuggggaaggccccugccagcugcuucuacaaugcuuugaaaucugggcagagacgaugauugggcgguggugugauacagagccaaccuuucccuuucuguuccguuucaguauggaaauuccggaggcccguuaguaaaccugguaaggcuuuccaguaucugugcuggguuuguuucgucugugggcaugucuuugcuuucucuuugcaugugagcuugucagaacaagcagucagcuuuauagucagcuaugugaaugcccuguuccuuugcaccuuaccccaccagcccuuucuggaagcaguaagguuagaggacucuucuuguguuucaagccacagguggaugccauggaguucaagcccagucuaggcagaaaggggacugaaaguccccacaguacugccagcugcagaaagguaccuucagccuugaggguugcugagcggagaugagcuggccuggcucggauccaugccagaacucucccugaaugccuguggguaugacggggaaccaccuguuugcucacagaugucucacuuaaccuagacuucagcacuucaguauaagguugaaggcuucaggucacagaaugccagcgcuuggggguuguuugagagaguaucaaguagaggccacccaaugguaccguccugcuggaucccuuggugucaggaauggacauguacaaagcacaccaggaacaauguauacugaaaguucucagaguccuuuugucagcacagcaucaggucaccagaaacuucuuagggaagggacacagcuuuacuugucccugccauaccuuggggaagcuguuaggagugaggccuguggcucaagccagcaucuagagucauuggaaacaggagaggaaggaaggauggauaguuaccuuagcaacucagacaucccuucccaugaaaagagaaaauauuguggaguuugaaaucauccaucuaugcaauaaggcaaccauuuagcuucuaccuggagcuucuuguucccuucaaagcugaauguggguggcacuacccaggugcccuaaugucucuccucguuauuucuaguccuucuccuuccagcccuucugauucucagacacagcucaaauacuucccucgcucauaugucuguguauaugagcauuugcauguuuguggccccaaguguguguguguucauuggagggagaggguguugcugugcacauguguguauuugugccuguggaggcccgggguugauggaggaccaucuucauucgccuuuccccuuagucagugaggcagggucucucaguugaauccagagcuaggugcuacuacagcuggcugcuccagccagcuuucucucggggaucucgccucuaccucugaggcuggaauuacugccaggucaccacacacacacacacacacacacacacacacacacacacacacacacacacgugcuuuuauuugcacggcagacacuuuaaccacguugccgucuucccggcccacgcuucuuuuuuauuacuauuuuaauuguacgcauuuguggguagagccugggaugaccagucaagauagcaucuuucucucaaccuguuuuugaaacucggcuucaaacuguagcucaggcuugccaggaucucacggugauccuaucucagcuacuccagaaugcaggugcccuaacgccucucaccacaccuggcaacacauuuccaagucacccguccuauagauuuuucugcccucuuccagccugugccagccucugacccuccuggaguuagugagcugugucccuugcuuuuucaggauggcgaggugauugggauuaacaccuugaaggugacggcgggcaucuccuucgcaauuccauccgauaagauaaaaaaguucuugacagagucccacgaucgacaggccaaagguaacuagagcagggcauuccggagaccuuggcagguuuacaccagaggcauagcugcccuuaaggaauugggagaagggaagaugacaguugugaagaucaggccuuucaagcugagaauaaauguuuccaggguggcggugguggcggcgguggugguuguggugguggugguugaacaaagggauucucauuccggacacccauagaacacacacagggucaugccacagguuuugaguauuuuuuaaagugagagacauuccucacuguagaucuggaacccaggccaggacugaacuacaguuuuugggugccuuccccccuuccccccucccuccccguggcucaugcuauaagguggagcuuuagagcucuggcuccugucuccccacacuccggaggacugugcugacuuacuuuuuuuuuucccccucuuucuuggucccuuuguugucacaccagggaaagcugucaccaagaagaaguauauugggauccgaaugaugucgcucacaucuagguggguaaacaggacacauaacuuuguaaagacaaaugaccuguauguauguacacuugggcuucacaaggcuuugugggcauucuugaagagaaacuauuucuuuccuucagucaucacacuggggaaggggagguguguggccuugggccucuuuguguuggcaggucugauuccaccccucccaagacuccgcccuccucccugaaggcaggccugagcaucagaaggcucacuagcaggcacacuuuugugccugccucucuccacuuauucuguugaaacucacauuccaggaaugccucacugcccgccccagugcccgccccagccuggagcaccggacuccccugcacacuggugugaggguguggcugcaagaaagcagggguggguccugccuuaggguacugaugacugauggacuuguuuuccugagugcagaaguugcugcuugggauugccaggcucaugacauacggaagagguucgggguggaugggggugggggugaggguaccuucaugaaguacaggaaacagaauugacuagcaagucugaauaucugagucauucgagaggaggauguguugauagcgcuguuuuauucaauugucaaaauauuaagacauuccacacagguuaugaacaauggugcuuuucuuaguguugccaaggaugggauggcaugcugagauggaagucacaccucuugucuuuggaagcuaggcuauggagucaccuuccugggucguucccuuaagcucuuguacaucucagcuuacugggugcucagcaccguccccuucaggaugagguuagcaguguaggugugcccacuguauagccauguacagcucagcugugguggugacaaccaaccacagcagcaguccugugcuguugcuuaaaguaguuccuuacuauuauuuggaguccuguugaugcugguaggcaggccauuuuaaagcagagucaggggcuagggagcugguucagugggaaaagugcuuacugugcuaguaugaggaucuaaguucaaauccccaggacccguguaaagccaggcaaagaaguaggcgucuauauuccuagugcuuucucuguggagacgggagguaaacaggagauucccugucacaggccagcuagccuaguguaugcagcagcaaacgagacccugucucaaacaaggugcaaggcagggacuggaggugguccucagaccuccauauaaauguugugcugugccaaagccucuagaugugucauggucaaguaggaucagaagacuucaagcugagugcuggccugagaagauugugggaagcuaauauuaacacaagcacguuuucucccaagcagcaaagccaaagagcugaaggaccgucaccgagacuucccggaugugcucucuggggcauauaucauugaagucauuccugacaccccggcagaagcgugaguguggaguucucccucuuuuuccugauaacugcgugguuugugggucagggggcaguguccucuuugugcuggcucagaugaccaugugggcccucacuuccuaucagccagggcuccugacugccuugggcucagggcuuguccacagaaauaugcuucuucccuugggucgucucaggggucauccauauaggaggagcacucacuaaugggcucgcugggaauccuuaggaagccuggcuguagagagagcuugauagcgcagauugucccuucacagagccuucuguagcuguauuugugacuagugaagucggagaugccaacaccuauagggaaacugaccccaaugacaucaaaacaguagaagcagcugaguuggaacuucggcuuguuuccuggacccccugacaucuagagagaaauaaugugcuaaagaccugcacgugacgcccuacggucagacccggccugaugccucuuugugagcugagaaaaaaaucaguucuugcauuauuuuuaugguuggggaaaaacauccaaaugacacuauuuugugauacuguaaauucucugaagugcaaauacgcacacauguuuuauuagaccacagcuguguccccugacaagaugacaucuugucuggagcaauuuuuaugcugcugcagcagaauugaauagcuaagacacggagaccaaauacucugcgaagcuuaagcuguuucccaucuggcccuuuguggaaaaagucuguagacuuguauuagaacaagucggaccuugguagcauagugauccugucacguacgaacuaagguuccagccacagcacagaggagucaucucugaauagaggcauccaacauuccuggaggaaucgcuuucuaaauuacaguuccauucaugaggaaauuggcuguggucauaggaucugguguuuccuuguccccucugaggacaguugaucauaguucacacagauuucauaggcauuucuacaagggacauuauugauuuggucuuaaaaaauaaucucgacaggaaaugccaucuucucugcuugaagucauuuccguccgaggucuuaccaccauuuccuauagcccccauuuguucuggaccuuuggguucuaagcugugccuuucuccaugacugcgaggaauggaaaggguuaacaguguguuucccuuugcguuucagcggagggcucaaggaaaaugacgucaucaucagcaucaacggacagucuguggucacugccaaugacgucagcgaugucaucaaaaaggagaacacccugaacaugguuguccgcaggggcaaugaagacauugugauuaccgugauuccugaagaaaucgaccccuaggcagaggcaggagccagacuucauguuucccucaaagacuccaggggauggcgcaugagaacugagcuggugacgcaggacacccgggaccuuuguccaacauuuugcuuguucagggaacaccccugccgacagaauccuucuugauaguuugcgggcaaaacaaauguaauguugcaggugcacaggcagaaguccugccuucuguaugcuauguaugcagcgugcuuuuccuuacaagcuugggcuguuccugcuuacacagucaacauuugucccuucccuuagccuaaguugucugacuaaugcaguugacggaugcguaggcaagaggaagguccucgcagccauggucuugggcguguuuacacuuuuccuccgagucggcacucagaggaauuugaugccccgagaccacaggugggugacccuggcuucugagauggccaaaaaugccucuuaggaauccuggaacccggaguacagugacuuugaguuucagcuauuaaaauacuucuucau

SEQ ID NO: 12401 - RNA, 18672 nt, Mus musculus
uaauuucuuacaaaaauacuuuacugaaugaagcaagaaaacaccuauugacuauuacauccuguaggaucuugcuccaaaugaaagggauauaggcuaugucuaguaauuauguaaauauaaacaaaagacuguuaaaaugucacuuuuauuuuagcacaccugaguuaagugugggacagugaaacaaauacaacaggauauauacagcaugucaaggaggcaggcuuuaaaaccaugcuauagaaaagagaagacugggaggacgcccgauuuaagcagcuuuggauccugauuaauggauaugcaaauauaguauucuccaguggauuuggcaaagauuuuguuuuucauuuccagucuuuuaaaguagacagcugauuuucagagcacauaagauuuaaauacaaacaagagaauucagcagagugauaaaggugccugcaacaaaacugaccacccaagguaaugguggacagcaaggcgagaauccucauccugcaaagcaggacgagggggaacugcaaagugggguucguggguaaccuuagcuucuacuugcuacucaguucacaaaguuagaggccuuuacagauaacccgcacgcacccuuuaauuuucugcuauguaauaggauuauaaggccacaauauuccuuuggggaaaacccuuuaaugauuuuaauaucacuuacuuguucuuuugaaguguaaagugucuuaacuggauuaugauuacagaucaguuuuaaauacaccauugcuacuauauuaaaauuauuuauacuauuuauaucuaauauucaaagaaauuuacuauuuauaucuaauauucaaagaaauuuacuaguaaaugcuacaauaggcaucagucugacaugcuuauuaauugaucccauagguauaauuauaggucaugacaagagucuauucugucucacuaaaucaggaacaccgcauuuacagaacaaauuaacacacauagugcaaacacccaaggaccaugcuagcucuucaauuagcugucacagcucagacaugaauccucacugugugaacagaagucagauccaaaucuucaucagaaggugcuaguggaaguugucagacgccuuccaauguagauccuagacagaaaagggauggcagccaaucaggucucacaauucucaggugacuuuacaaagcucaaaggggccaggccaccaugguuacagcuuuuggaagggaacuggccaccuuauacuugauaaaguaugacuguaaucuucucuuuuuuaugauuuuuauuuuauuucuaugugcauugguguuuugccuacauguaugucugugugaggguaucagauccucuugaacuggaguuauacaguuauaaauugccaugugggugcugggaauuaaacccaaguccuccacaagagcaagcagugcuccuaaccacugagccaucuuuccagcacaacugucuacaaucuuuaacaaguguucuuagucaucuaauauguauuucauauuggucuaauuuuucuuacuuaaaauuuaaauucaguuguuucaaacauucuaauaaaacuuacuaauauauuaacaacagaaguugaaacucaguaccugucuaccauguacaaggucccagguucaaauauaaguucaaaccaaacccauauucuaucaccauacagcuuugcauucccuucuguguugucaaauguugucaccacacagcugcaggcaggcuggcuucauauccaguuaguucauuaccucuaaccucaaagcccaaccaaggaauacguaaugaagccucccuuuucugcacucagugaggugggaacugacgaucucaggaaaggagacaggagagaauccuaccuggccaggucuguguggacugggaagaaauaagacugggcagugagcuaucuggacuaaagaggguagcauucaugaaagaauggaaguugccaagagaucuugggugggauggcaucaaguucugagccugggaaggaugaaggacagaagugguagauaggccuauauccagcaaggauucccugaagggaaaacucagcuuguacugaacacagguuccuggcccuguccacagguuucccuuugcugguucuguucuguuuuguuuuuugagaccaggucuccacacguaacccuggcuggccuguaauucagagauuccccuaccuauguuccccaacggccacugaacccuguugcuugcuaguucugagaaaaggguuccaaaccgggcgugguggcgcacgccuuuaaucccagcacucgggaggcagaggcaggcggauuucugaguucgaggccagccuggucuacaaagugaguuccaggacagccagggcuacacagagaaacccugucaagaaagaaagagagagagagaaagagagagagagagaaagagagaaaaagagagagaaagagagagaaagagagagaaggagagagagagagagagaaagagagaaagagagagagaaagagagaaagagagaaagagaaagagagaaagagaaagagaaaaagaaagaaagaaagaaagaaagagagagagagagagagagagagagagagaaagcaagcaagcaaaggguuccaggugauggggaugcaccuguccaugagaccaagugccaggagagaagugguacaggcagguagggcugcaacccaguaagcuaagaggggcguccggcacccaggcagcucuauagggacacugagggucugcagugcaggaaguuaagggcagggaaaacugggauguaccuaugaaacccacaacaucccaagaaauuaaacacgaaacagacugggcauccgccacaugaacagcuuuuggggaaaagaauaugcagacuacagagccucuucugccccaaacauacccccaacuaacacagaccagaagccuacagaggcaucccagccauuccaauagacugcagucacccaacacugucuucauauagagggugagcuuaccccagcguggacggaggguauggauuggcuuaaagaagagaaagggcugggaauuuagcucagcugguagagugcgggaccaugagauuauguaucccugggugggcagcaucuguaaucucagcacucgggagguagacacaggaagaucugaaacccaaucucaucccugcgaggccagcacagaauauacgagucccuuugaugaccugcucuuuagcacuagucccaucuaaagaauccauagcuauacucccuggucuguuucagucuaaacuagauacaaaagcagaaaccuaaaggcggcacagaggcccggcaugagaacccugcgcaaggcaugguggguaaaggcaccuuccacuacacgggauuuuuacuugacuugggaauaaguuugugaaaaugcaccggccuaaaaucaucucucucuccauacaauguagaaauaacuugcuggggccuagacucacccaggucuacccugucacaggguguccacgcucucauagaaacaucacuuaccccaagccaauggccagcagaugagacaguaacagagauggaaggaaaaccuucagaaagucugcugagaaaauucccccuuucuucauaacgcuuguguuucucaugcugagaguagcugugcgcuucggguguuuaaaaaggaacucccuaagguagaaagaaacugccaaucaguguccccuuguuaaaggaaaaaccuugacuaagaauagugaaaacggacuuacuuggggggaauauuuucuggucgacuugaccaaucccauauccaaucugaguuuuucuucaggauacuuucaacuucucuucuucucucaauauaaucuuccucagacuaaggaaaaguaaauauuaaauaaaguaggugagcuuuccacagucacaugaaagacaaagucaguaagcucaacagagaaccccaccugacaugguauuaacuaucccacaacuucaaaugcauuacaaauuaagacauuuaggugguaauguccccucagagauauucuuuuaauaucucaaaauaaaauaugauaaccacugauauucucuuaacugauguuccguuacauggguaauggaaacacaaaucuguauguauaaacacauuuaacaaaacgcaacagaaacacugcacaauuacaauccucauuuguacaccgggucacaugacccuagcagcugauauuuauagcuaccuccucuacuacccauucuguauauauuuccuccacuuucagcaagcacugagggcagugacccacaccuucacuccugaacggucugugcacuuugucauccuaccuagauuagacuguuuggaguuucccacuaucuuuaaucacaggacaugguagcaccaagagacacccuaaaggaucuccugaacccagacagacauaaucuuucucaccuccauuguggagaagcaauccaauuuccccuugguaaucuggaucaaucacccuccuaaaacugucauuccuuucuuagccuguucauuuaagggcacccgaaacucagcuuccaguccaauggaaugguuguuuugacaccuggcauaaguucccccacccccaacacucacacacacacacacacacacacacacacacacacacacacacaccuaggcaaguagaaaaaggucauaggaacagaaugcaaauaaauuccuagugggucacuaggggugauuguuguaacuacuccuuuuucuaccccucgauucuugaacccauggauucugguuaugagagaaacuauaccauauauuggaugcugauuuaaaaaguauaccauugccgggcagugguggagcacgccuuuaaucccagcacuugggaggcagaggcagguggauuucugaguucaaggccagccuggucuacagaguaaguuccaggacagccagagcuacacagagaaauccugucucgaaaaacaaaacaaacaaacaaacaaaauauauaccauuguuagggauccauggguucaaggaauagaaaccaugggcauuuggccauguaacuugcuugugccuucgggaccuacuuggaccugaucagauauauagauagcccuuucacuugauaguggauuguugcuguacacaaucacuuggugggccauauaacauuccacucaugauaggcagcucgggucacaugguaacuugguggcccauugucaaauguucaguuuccacuaaggcccaauaccagaccucauuugaagggaucuuaaucaucuaucucuucuacaaaauaguacacugauucccucuauugaugacauuaugcugguuggaugaagugagaaguggguaggaacuaacuacuuuggacuuguaacacauaugugcacagagaauagaaauaauucaagggcuuucuaccucagugaaguguaagucuggugguaugaggcauuugagauauuccuucuaagaugaaacugcaccaagaaagaacacaauguuuagcaggccuaucuauuagaauucuggaaauggcacauucuucucuuggguauaugauuaacccagcccaacuuugaauggaggcugcagcacaagguucuucaacggauccaggcugcucuacgacuuggacaauaaauaugauccagaagaccagugguacuugagguaucagugcccaguagggaugcuguuggagcccuggauggaucccuaucagugcccaauagggaugcuguuggagcccuggaugggucccuauagauaaaucacagaauggcccccauacacuuagagguuucuauacuuaggaaugccacuccuuggggggauuaggagguguggccuuguuggaggaggugucucacuggcuguauggguuaagagguuucaaaagcccaaaccaagcucuuccucuuccugcugccuacaaauccagacauagaacuuucagugacuuccccaguaccacgugucugccauguuuccuaccaugaugagaauggacuaaaccucugaaacuauaaacaaguuucaauuaaauauuuucuuuaagaguuacuauggucauggugucucuucacagcaauagaacacugacuaagacaggcccugaucucacaacaaugcuaaaggugcucuuuaguuucuacugaguuaauauuagaaaagugagcucauggacugggguacagcucaguuuacagaaugcuugcccagaauccugggcucuagccccacacucacuacauaagccaggcauaguuguacguauuuguaaccaccuuagcacuaggcaaaguagauuccucaauuaauuaauuucuacaagauauuuuuuuaaaugagcugucuggggcuggagagauggcccagggguuaagaguacuugcugcucuuucagagaacccaaauuaguucccauaacccagaccuguugguggacugcugcccguuaauucuaauuccagugccuuuggcuucuggacaccaagacucaugugcacauagcauacagacagacagacacacaauuuaaauuuuuagaaauucuauuaagggaaagugguggaugggacgauggcucaguaaauaaaaugcuugcugcacgagcauuaggacccucaguucauuaggacccccaauaccaguggacaaguuggugcacaucauuaaucacagcacucaggggacagaggcaggaggcuuucugugaguuuaagaccagccuggucuauauagcaaauuccaggcuagacagagugaauagggaauucccugucuuaaaaaaaaaaaaaaugggguuuaaaaugccuccauacauauggcauucucucaaacaaacacacacauaaacauaaauaaaaacuuuaaaaaccacagauccaacacucauguaaaaugccaggcacagugaguggugaguuccauaaccccaggccuggagcagaggcaggaggaucacuggagcucacuagccagcugaucuacacacaaugguaagcuccauguucaaugagauacccuuccucaaaaacuaagagaacaaagacucgcauauguugcaagucuaggagucaguuaccggacucaugauaugcugaaucuuauagcauguuccuaucuauggcuuaccagagugcuguuuuucucgccaaagcuguggcugucuauuucagcucuguugguaucuuguggugucugggagcgaggugggcuugauuaagaaacggauaaaacggagcagcaugucaauugugucauaagcagcauaaauuccaaggggcucuuaccucauuaagggggugguagagacucuccaaagcaugucucuucccuuuugccuaucaccagaccagugccaaacaauuccucagucuucugagcugaucacauaggagccagcuagacagucccuagggaagccccacccuccugcaugaucgguagcauaacccuugcaagcaucugaccuuugaccacugacucucagccacacaccuuggauuugcucccuaguagugcugccuaggaaccgaagccagcuggggacaugaacaaaacugcucagacuugguguucucagugaacagcuucaaaaagggggcagacuuuuguuauuugucucuagguuuaauauagucccucuagacuugagccccagaucacuuccucucagcagacuccagaguuccuuguauaauggaguuacucccaaauguggccucagaccuggcaacccacccacaaaaacaugcacaauugugauuauccaucuacuaggaacaucaacacuguaggagauacccagaaaacauaccugucacagugagaacucuuggagcuacuucguccagauucaugcugggcauccaacaguauuuuuuccaugucaccauuauaaauagagacggaggcuggaacgcugcucccauugccauugcugaagugcaguucuacccaggagccugagagaacaaaaagggcaguuagcaaucugaccacuuguggggcuugaugacuuaaucccagcacucuggguucaaggcuaggcaggacuacacaauaaguacuuguuccaaucaaucacucaaugaauaaacaaacaaagauauagacagacagacagacagacagacccgcccauucacauucccaggaaauaccaaacacaugcauuucugguccucuggccucucucagguuccugaggcugaaaacacuguacucuacgucuggccauuccuuuauuccaugcaguuauucuacaaaucugugauuuaccagaggccaagauggggauccuguuuaaguuggcauaaaaauggaggcccagccccugccucggccucgaccuccugggugcuaggcuuacaaucaugggcuaagauaaggcucgaucuuagugaugcagaggaugaagacuuuuuagaaucaccucuuuccuggaggugcuaaccuaacacauucagguuauuccugaguggccaaaauauuuuccagcaaggcuauaguuaugauaauggaggcuacugaggagcuuccuguccuguuagcagagagaacuuacuaacguguacaaacacuaagucagagaaacugcccuugaacuucacugcagguacaagacagagcagaauguuccagaauuuuccugcugaguuauugaauucauuagcacuggaaaaucugacugcaggcuggagagauggcucagugguuaagaguaccggcugcucuuccgaagguccugaguucaaaucccaaaaagaaagaaaaaaaagccgggcgugguggcgcccucgcgccuuuaaucccagcacucgggaggcagaggcaggaggauuucugaguucgaggccagccuggucuacaaagugaguuccaggacagccaacgcugcccagagaaauccugucucgaaaaaaaaaaaaaaaagagagaagagaagagaaaaggaaagaagaaaaaagaagaggagagaaaagaaaagaaaaucugacugcaaauuuucacaaacagagucucucugaagaacuuuacagaaaaugaaaaguuaaagaaguuuuucagugucuuaacaaccaaugcagauggcaauacugaguucauuucagccguggaaggauuuaaguauccaguguaugcuguccaguggcuuccugagaaagcgcccuuagaguggcagaagcugcaugcuauuucucaugcaccaacugcuaggaagacuucaacucuacucugcagacuguuuucuugcugaagcucgggaaggcagucaccacuuugagaacacacuggaggagacugaacccuuaccuaccaguucugucucguuuacacugcagauauuucuucauuucagcaaucuuuuuuuuuaaacauuuauuuauuauguguaaauacacuguagcugucuucagacacuccagaagagggcgucagaucucauuacagaugguugcgagccaccaugugguugcugggaucugaacucaggaccucuggaagagcagucagugcucuuaccugcugagccaucucgccaagccccauuucagcaaucuuacauguuugacugaaagucuucaauaugguauaauucugugacugaauugcuaacacugcucagggcaguaugagaaagccacacagaugucuuugcugugugccugguucugauucauggcuuaauacaugauuauuuuuuaucagauuugauaaccugacagugagaaagauuagaaauaucaugguguuuuucaugaaaauuccuucuaugucugaagauucuaagauauaaaaaauauaaaaaaaugaacucucaguguacacuuugguucucuaacaccacaauaauaaaugaacucuugguacuguuccaucuauggcuugcuuucaguuuggucugcugaaugcaucuacuaggauaguaaagggcuggugcuauagaucaguggaaguaugcuugccuuauaaaaucauaaggcucuagguucaagccccaacacugccaaauguuuguguguauacauguguaguuuucaacagggcaugguaguacacacccguaaucccaguuauuuaggaggcugaggcaggaggacuaccaagcuggaggucaguuugugcuaacuuguaauaguugaguucucucuuuccaucauuggguccuggggauugaacucagguugccaggcuuggcagcaagccccucccaucucaauggcccuucccaucucaauggccccucccaucucaauggccccuggugcuuucuuugccagaguaagaguguguaugggccucauucugggcccaagauuacuuuucuauuuugacucacgggcccauuugccuguagaaaauccuuuugagcuaaccuguucuacacaucaaauugaagggcagccaggacuacaaagagaaucccuaacaaagaaaugaaauaacugguauuacacagaacagaaagagggagaagacaaccacaaaugacuggaaaaaaauguaugugcuggagaagcugaagaaacaaaucuuguggccacuauaacuuuacuaaauacaguaauaaugacugaguuguucugugucccagguaaugugcuacuauuugaugaugcaacuaaugaagaaagggaaccacuccugaucaagucacugggaguuggggacagagcucagaaguagagcuuguaagaggcccuaccuaguucugaucuccaguaccaaaggggagggaagaaaaaggcaaaaagauugcuucaaguucaaggccagcuugggcuacauugagacucuugucuauaaacuaccccgcacacagauccagaaaaggaaaaaggagcugugcaugguggugcacaccuauaauccaguagaggugggaguucuuaagaguucaggaccauuugggugugguagugcacgccuuuaaucccagcacucguggaggcagaggcagguggauuucugaauucuaggccagccuggucuacagaguauauccaggacagccagggcuacacagagaaacccugucuccaaaaaccaagggggaagaguucagggccaucuccagcuacaguucaagggagccugagagcgcccugugcuaugugugaccucccuaaaaccaacaacacccacuuugaaaagccaggaaugauggggcaucccugaaauccuagaauucaggaggcagaacagaacuguugcaaguuugaggccagccugucacacagaucgagcuccuggucagccaaagcuacauagugagucucaaaagcaaaacacguacauauucucuagaagcaggagcagccacacugcuuuccagagcacuacaaauaaaccugcccucaacuguguacucaaugcagaaugugccacauuaaucagacaaaaaaacaaaaaagcccagaaaucaauuguggauuuaucguuuaugccaccaacaguuucucaguaagauaacaugauuauacaacacaaacuuugaaauaaacaugauuuuccucauuauccucucagauugccucauagagaaagaagcaggccuaguccacaugaaacacaucaccaacucagaagggcagaguccagagccccucugcuguugcauacaggccccagugcccucccucugugaucugcaaauccagccucaugucuuuugcuggaccuccucccuucacugucugcuaacacccagaagccaggaauagugccucacaccuagaaucccugcguuccaagucacuaaggcgggaauguugcucugaguucaagucaagccugggcaacagugugagcuccuaaaccucaccuacuaaauaguacagagcucagcuaugggcaguucccuuugucuaggccaaucuuguauucagaucugagccugucccaauuuaugugaugaagcuuaaugcuacccauaucuuuucuggugucuuacacaaacaguuugaggucauguuuucuucuucccaguaccgcguccugaugccaaauguagaguuuuuccuacacuaacuaccaauuuuccaaaaucaaccaggggaguccaagaauucaauauucccacaauaccuccuaagacucguaccaaaucccauaaauucaaggcugaaacccucaaggaugcugcacaucacacaccagccacaagcagaacacacagacuauccacacuucagcuccguuacaaacuuaaacacaaaaacaagaaagaaaagcucgucucugauuuaaugcugugcugaaguucagaacucaagaaaacauguggcuuaaguuucuaauacagaagaaaacauguugcuuaaguuucuaauacagaagaaaacguguugcuuaaguuucuaauacaguucagaagcaaccacauggaagcacacaccaagggcagagaauaccaccuuccuguugccaacuccaaaaccccgcaaacauucugcucaaagcuggcuauggugacauuuucuuuuauucuuaauagcuuaaccuccaaaucccuccucucccugguauccuaagugucuacccucugacaacuuauuaguuaccaaacucuagccugaggcuauucugggucucaaauaauucaucucauucuugagggcuccuuauaaaguugaccugaauaacaggauaaaacuccuagcuaagagauuugauuuguuucaucuauacauacacacaccccaucacuuccuagcacuugggaguaccaggauuuuagacacuguaguguauaaaguaagacguaucucaauaaauaaauagauagauagauagauagagauagauaaauagauaaauaaauaaauaaaucggacacucaggaagucccacaacuuugagagcuuguauaaggaacuaagucaacagauagauguuuguacucauugcacaaggagcaaccaaaaauggagggagccaacuaucuguacugaucugcacugcuguaacaguaagccacgagcugggugauuuauaaaguauuucucgcacuuguggaagcugacaaacccaaacucuaugcugucuguaaggaagccaguucccuucaucagaagcuucaccugggcucaucacagugcagcagggcccuggcucugcuuuucucauaugggcagcauucauaucauagcaguacuuucaaaaaccaucaggaaauccuggcagugguggcgcacacucgggaggcagaguuacacagaacucugauucagaggccagccuaaucaaguuccaggaaaagcuacccagagaaacccugucucugggggaguagagggcacagaucuguagcaaauaucugcaaaaggccccagcgccuuagaggcggggaaacaaucccauuuggaaugaucuggugcagaacccuugaguccaaacgcuccaggaaugauuuacuagggaaaaaguuuuaucauuaaccugugucuggacaggaacuguaaguccuagaaaacggagaagacuucauuuacauacauccugcagucauucagcagcagcuuccaucguuuuaaacaagcaagaaaggugugaaugugaacuuacaacccuaauagaacauuuagaaguugaaggcgaguuuaaggccagccugggcuacagagugaguuccaggacaaccagagcuauacagagaaacccugucucgggaaaccaccaaaaauaauaauaauaauaauaauaauaauaaauaaaaauauaaaaauaaauuguuuuuaauguuuuuaaaggaaaaaaaaacuuaacaucaaggaaucuccucagucaacacacaauuuauuucauguaauuuaauacauuuaggcuucaagacagcaagcagugccccauuuguuuuccuguccacucucccacuucugaguuacaccaacaagauacacaucaaguccuauauacaucuccugaguguagaaugucugggaacugaacucagguccccuaggaagcagaaugcgcucucauguguagcaguguuuucccugcaguauaugcuguguaccauguaaguggcgcccaguuagacagaagaguguauuagaguguauuagaacuuacagucguaaacaaguguucuuaacugcugagccaucccucuaauccuucauuuggcuucggagacagaaucucacuccauaagccagguuggccauugugcuaguugguuuugucaacuuaacacaauuuagaaacaacugagaaaagagggcuuucuggaguauuugauuugaacuuucaaagacuggcucucuccuucuaccauguggguuucuagggaccaaacucagaucaacagguuuggcagcaagaaccuuugcccgcuuagcuaucuugccaagccuauuggaagugagucuuacugaggaacuaguuagaugaggcuggccuauggguuuauccauaggaacacgaucuugacuguuaguugauauaggaagauccagccccguguaggcaugcuuauuuauggcugagguuuauagaaucacauaaauggugagcuggcgcaugucugucauucuagugcucuagauggugagaaaagaaucaaaguuuaaagucauccuuggcuacuuacuagguuaaaaagucuagcuuaggauauauaaaaccaccucaaaaauuguuuuaacuaaaaaaaagguuaucuuuuuaaaaaagauuuauuuauuuauuuauuuauuuauuuauuuauuauauguaaguacacuguagcugucuucagacaccagaagagggcaccagaucucauuacagaugguugugagccaccaugugguugcugggaauugaacucaggaccauuggaagagcaagcagucaguacucuuaacugcugagccaucucuccagcccaaaaaaagcuuaucuuuaccucagucagacucuggaguacagagauuagaggacugcucuaccauucugcuuuccaaacugcuuauagaaugacaacccugggagugagucccuucucuguauuacccucuauaucccaaggcaaacguguagacugucaaugccuaacaauaacuauacccaaaagagccccaugcagagaaacacagggucccuauucucauguccacgucucaaucauggcuauggaaggagaaucaccuucguugucuuucccauaguuuuccagaagcugaggccaacuugaaaacagaguuagagagccaagcaaauaugcugauaagcucaagcagggacagcacccagccagagcuagcuagcaguccucagaagggagcaggcacccacacaaccuccacacaggaacauaaugccacaggagaacgaugcuauagcauucccagaaagccaagcaagggggcaccaagucugggggaagcacugccccaaaccacacaggacuucuccagaagcagccauugcugucuccacaccuaaacagccccuuggguuaacuuaggaaguuggcaaaugguuccgaacugaaucugccuaguacauaaccuagacuacuggcuuccuuuucagucacauacacaaaugugcauuuuauuggaagugucucaugcaggcugguguuaaacuccugaucuuccugccuccaucucccaaacacuaggaucagaggcuugcaucaucucuguaccuacuggauucuaagacgagugaacuuaucucucugccuauugcuaggcugugccugucugauacauccugagucagguggcuccagguaccccucuggugcugagcagucugugccagguccuuaacugaaguagccauccuuaguuccacuuaaccucuggaucucacuaggacuauuuacagaggcuagagccaaggagaaaccccuucaguguauccauguuuucucuucaugcaagucuguccuugauaguuugccuauaaccaacagaaccacucaucagaaccaguugcagacagggcagcuagcuaagugaagacuuauuaaaucuauacaguggaccuuucaggaaagggcagcaaccaaggcacagaaauaucacaauacuuaucucuccuccagcaugccagaagucauacagaaaagcccugcuccuaaacaccuuucaauaagauggagcagagguaaaaagggaacagaaccaaucaguguuguggguaacgccuucaguaacgcuggucccagagguugcuauggggaauauuugcugucccaccuaccaacaaggcuuccacagcucucagccucagaaguaaacacgaagcggcaaacagaggagcugccucagcucugacuccaagcugggauucacauuucauagggcagcugagauaacccaugugacuaagugaccccuccuacccugagcuagacagugagccagugcugagcugcacguacaccccaaacaauggcccaaauccuuagccugaguuuccacaccguaaccaucuuuuuauagaauaaguaaaagagaaaaacacaaaaccuuaacccuugaaacgucuaaugacaacccccuucugccaaugacucagcagucuggcgugcaugucagcugaguguauguuaaccgagaccucucaggaauacucagaaacuccccuagaugaagucuuaacagcauagugucagaaaucaaauuucaacuagcuacgaaagugacuuuacacaaaacaucacuugaucucuuaagagaaaagacaaaaaaacuucucaaucaaaaaauuccaacuguuugacguuugacauuagggaauaaaaccugaauuacgagauuuuuuuuuuaauguggcuguaguuugaaaauacagauucuguaauguguuaggcugauuaaauucugccuacuaaaaucucguuuaggguaauaaauucagcuaacucagugucucugaaugcaagcuuuuuaaaaacucuuuuaacacaacacugcucugaguuacccuauuccaguacuccaggacacagaaucucuggacagcauagucuacacaaguucuaggacagccagagcuauacagagaaaccacgucuucacacuaaaguggguacuguggcccacaccuuuaaucccagcacuagggagguggaggcaggcagaucucugggaguucacugagagugagacccugccuggggggggggaggggaguugacacuaaagcauucauuuuaaagguuuggaaagccucucucucacguuuacugacaugcguuuuaccuggugaacucuugcuucagagaguacaaaggucaacaggauccuccuccagucucagggccugagacucaacucagacucaacucaggcccaccagguagcucucagaaauggacaauggcacauagcacccaggcuggccuugcaaaacuagcagcugucugcgcagugcuaacagucuguaaaggcugaugcugggagagccuuucuguuauuugugagacagggucuggcuacagagccccgaacuagccugguacgacuguguaguccaggcuaaccuggaauuugucaagacucaacuucacccaccccaugaugggauuuuaggugugucaccacacccagccucacuuccauuuuaaccuacaaucuacuucacugcuugcagugagccuacugaacuaaauuauaagcacuuuacccuccuuuugagcuguuguagcucucuuccacacuaccuccagccauacccccucucuguuuuucucuuuguagacuuggcuguccugaaauucacucuguagaccagguuggccucgaauuuacagaaaucccccugccucugccuccugauugcugggauaaaagguuugugccaccacugugcggcuaucccaccucuuaacucuaaaaccugacagaggucugaaacccuguauccuccucuuccaucaggaaguggcaacaaagcaagccagggguaaagauugggggagaggggacacagcggcaaagccuguuaauuccaaauuccagcuacucuagaggcugaaccaggaggaucacaaguucaagaccaguaugucuuaaagcaauaaaaugaaaacugguaguguugcucgggaaaugagcacuuacccagcacguucagaucugguucuguccccaguaccaaguaggaaaagugaaaggcacuacagucauaaauauuaaugacuucaaucaaagcacugaaaauucaacugcaaccucuaacucacuuaagcaacucugaacaaggggacgccaagggccugaaaucugagcuacucgggaagcugaggaaggaggaucgcagaguucgaggcuccccugaccuacagagucugaaaauacagaacuaugacagugugaagaacagagcaggaaagaaagacccggccugccugugaagguacugucuguaagaugccccgaggcucaccacccagccccggcugcaccgaacugcaucgcggccuccacucaccgcaccccagcccgcgacccuaccgccuccgcggccccucucggcccacugccucacccugcagguucuccuccccgcucugcgacaugguggcucggcaaaggagcccgaacccaacugcgacaggccugggaggcggucaccgagagguagcaggggcagccugcgccgcucaguucugaggccaggcgacacuggacu

SEQ ID NO: 12402 - RNA, 18672 nt, Mus musculus
aguccagugucgccuggccucagaacugagcggcgcaggcugccccugcuaccucucggugaccgccucccaggccugucgcaguuggguucgggcuccuuugccgagccaccaugucgcagagcggggaggagaaccugcagggugaggcagugggccgagaggggccgcggaggcgguagggucgcgggcuggggugcggugaguggaggccgcgaugcaguucggugcagccggggcuggguggugagccucggggcaucuuacagacaguaccuucacaggcaggccgggucuuucuuuccugcucuguucuucacacugucauaguucuguauuuucagacucuguaggucaggggagccucgaacucugcgauccuccuuccucagcuucccgaguagcucagauuucaggcccuuggcguccccuuguucagaguugcuuaagugaguuagagguugcaguugaauuuucagugcuuugauugaagucauuaauauuuaugacuguagugccuuucacuuuuccuacuugguacuggggacagaaccagaucugaacgugcuggguaagugcucauuucccgagcaacacuaccaguuuucauuuuauugcuuuaagacauacuggucuugaacuugugauccuccugguucagccucuagaguagcuggaauuuggaauuaacaggcuuugccgcuguguccccucucccccaaucuuuaccccuggcuugcuuuguugccacuuccugauggaagaggaggauacaggguuucagaccucugucagguuuuagaguuaagaggugggauagccgcacagugguggcacaaaccuuuuaucccagcaaucaggaggcagaggcagggggauuucuguaaauucgaggccaaccuggucuacagagugaauuucaggacagccaagucuacaaagagaaaaacagagaggggguauggcuggagguaguguggaagagagcuacaacagcucaaaaggaggguaaagugcuuauaauuuaguucaguaggcucacugcaagcagugaaguagauuguagguuaaaauggaagugaggcuggguguggugacacaccuaaaaucccaucauggggugggugaaguugagucuugacaaauuccagguuagccuggacuacacagucguaccaggcuaguucggggcucuguagccagacccugucucacaaauaacagaaaggcucucccagcaucagccuuuacagacuguuagcacugcgcagacagcugcuaguuuugcaaggccagccugggugcuaugugccauuguccauuucugagagcuaccuggugggccugaguugagucugaguugagucucaggcccugagacuggaggaggauccuguugaccuuuguacucucugaagcaagaguucaccagguaaaacgcaugucaguaaacgugagagagaggcuuuccaaaccuuuaaaaugaaugcuuuagugucaacuccccuccccccccccaggcagggucucacucucagugaacucccagagaucugccugccuccaccucccuagugcugggauuaaaggugugggccacaguacccacuuuagugugaagacgugguuucucuguauagcucuggcuguccuagaacuuguguagacuaugcuguccagagauucuguguccuggaguacuggaauaggguaacucagagcaguguuguguuaaaagaguuuuuaaaaagcuugcauucagagacacugaguuagcugaauuuauuacccuaaacgagauuuuaguaggcagaauuuaaucagccuaacacauuacagaaucuguauuuucaaacuacagccacauuaaaaaaaaaaucucguaauucagguuuuauucccuaaugucaaacgucaaacaguuggaauuuuuugauugagaaguuuuuuugucuuuucucuuaagagaucaagugauguuuuguguaaagucacuuucguagcuaguugaaauuugauuucugacacuaugcuguuaagacuucaucuaggggaguuucugaguauuccugagaggucucgguuaacauacacucagcugacaugcacgccagacugcugagucauuggcagaaggggguugucauuagacguuucaaggguuaagguuuuguguuuuucucuuuuacuuauucuauaaaaagaugguuacgguguggaaacucaggcuaaggauuugggccauuguuugggguguacgugcagcucagcacuggcucacugucuagcucaggguaggaggggucacuuagucacauggguuaucucagcugcccuaugaaaugugaaucccagcuuggagucagagcugaggcagcuccucuguuugccgcuucguguuuacuucugaggcugagagcuguggaagccuuguugguaggugggacagcaaauauuccccauagcaaccucugggaccagcguuacugaaggcguuacccacaacacugauugguucuguucccuuuuuaccucugcuccaucuuauugaaagguguuuaggagcagggcuuuucuguaugacuucuggcaugcuggaggagagauaaguauugugauauuucugugccuugguugcugcccuuuccugaaagguccacuguauagauuuaauaagucuucacuuagcuagcugcccugucugcaacugguucugaugagugguucuguugguuauaggcaaacuaucaaggacagacuugcaugaagagaaaacauggauacacugaagggguuucuccuuggcucuagccucuguaaauaguccuagugagauccagagguuaaguggaacuaaggauggcuacuucaguuaaggaccuggcacagacugcucagcaccagagggguaccuggagccaccugacucaggauguaucagacaggcacagccuagcaauaggcagagagauaaguucacucgucuuagaauccaguagguacagagaugaugcaagccucugauccuaguguuugggagauggaggcaggaagaucaggaguuuaacaccagccugcaugagacacuuccaauaaaaugcacauuuguguaugugacugaaaaggaagccaguagucuagguuauguacuaggcagauucaguucggaaccauuugccaacuuccuaaguuaacccaaggggcuguuuagguguggagacagcaauggcugcuucuggagaaguccugugugguuuggggcagugcuucccccagacuuggugcccccuugcuuggcuuucugggaaugcuauagcaucguucuccuguggcauuauguuccuguguggagguugugugggugccugcucccuucugaggacugcuagcuagcucuggcugggugcugucccugcuugagcuuaucagcauauuugcuuggcucucuaacucuguuuucaaguuggccucagcuucuggaaaacuaugggaaagacaacgaaggugauucuccuuccauagccaugauugagacguggacaugagaauagggacccuguguuucucugcauggggcucuuuuggguauaguuauuguuaggcauugacagucuacacguuugccuugggauauagaggguaauacagagaagggacucacucccaggguugucauucuauaagcaguuuggaaagcagaaugguagagcaguccucuaaucucuguacuccagagucugacugagguaaagauaagcuuuuuuugggcuggagagauggcucagcaguuaagaguacugacugcuugcucuuccaaugguccugaguucaauucccagcaaccacaugguggcucacaaccaucuguaaugagaucuggugcccucuucuggugucugaagacagcuacaguguacuuacauauaauaaauaaauaaauaaauaaauaaauaaauaaaucuuuuuuaaaaagauaaccuuuuuuuuaguuaaaacaauuuuugaggugguuuuauauauccuaagcuagacuuuuuaaccuaguaaguagccaaggaugacuuuaaacuuugauucuuuucucaccaucuagagcacuagaaugacagacaugcgccagcucaccauuuaugugauucuauaaaccucagccauaaauaagcaugccuacacggggcuggaucuuccuauaucaacuaacagucaagaucguguuccuauggauaaacccauaggccagccucaucuaacuaguuccucaguaagacucacuuccaauaggcuuggcaagauagcuaagcgggcaaagguucuugcugccaaaccuguugaucugaguuuggucccuagaaacccacaugguagaaggagagagccagucuuugaaaguucaaaucaaauacuccagaaagcccucuuuucucaguuguuucuaaauuguguuaaguugacaaaaccaacuagcacaauggccaaccuggcuuauggagugagauucugucuccgaagccaaaugaaggauuagagggauggcucagcaguuaagaacacuuguuuacgacuguaaguucuaauacacucuaauacacucuucugucuaacugggcgccacuuacaugguacacagcauauacugcagggaaaacacugcuacacaugagagcgcauucugcuuccuaggggaccugaguucaguucccagacauucuacacucaggagauguauauaggacuugauguguaucuuguugguguaacucagaagugggagaguggacaggaaaacaaauggggcacugcuugcugucuugaagccuaaauguauuaaauuacaugaaauaaauuguguguugacugaggagauuccuugauguuaaguuuuuuuuuccuuuaaaaacauuaaaaacaauuuauuuuuauauuuuuauuuauuauuauuauuauuauuauuauuauuuuuggugguuucccgagacaggguuucucuguauagcucugguuguccuggaacucacucuguagcccaggcuggccuuaaacucgccuucaacuucuaaauguucuauuaggguuguaaguucacauucacaccuuucuugcuuguuuaaaacgauggaagcugcugcugaaugacugcaggauguauguaaaugaagucuucuccguuuucuaggacuuacaguuccuguccagacacagguuaaugauaaaacuuuuucccuaguaaaucauuccuggagcguuuggacucaaggguucugcaccagaucauuccaaaugggauuguuuccccgccucuaaggcgcuggggccuuuugcagauauuugcuacagaucugugcccucuacucccccagagacaggguuucucuggguagcuuuuccuggaacuugauuaggcuggccucugaaucagaguucuguguaacucugccucccgagugugcgccaccacugccaggauuuccugaugguuuuugaaaguacugcuaugauaugaaugcugcccauaugagaaaagcagagccagggcccugcugcacugugaugagcccaggugaagcuucugaugaagggaacuggcuuccuuacagacagcauagaguuuggguuugucagcuuccacaagugcgagaaauacuuuauaaaucacccagcucguggcuuacuguuacagcagugcagaucaguacagauaguuggcucccuccauuuuugguugcuccuugugcaaugaguacaaacaucuaucuguugacuuaguuccuuauacaagcucucaaaguugugggacuuccugaguguccgauuuauuuauuuauuuaucuauuuaucuaucucuaucuaucuaucuaucuauuuauuuauugagauacgucuuacuuuauacacuacagugucuaaaauccugguacucccaagugcuaggaagugaugggguguguguauguauagaugaaacaaaucaaaucucuuagcuaggaguuuuauccuguuauucaggucaacuuuauaaggagcccucaagaaugagaugaauuauuugagacccagaauagccucaggcuagaguuugguaacuaauaaguugucagaggguagacacuuaggauaccagggagaggagggauuuggagguuaagcuauuaagaauaaaagaaaaugucaccauagccagcuuugagcagaauguuugcgggguuuuggaguuggcaacaggaaggugguauucucugcccuuggugugugcuuccaugugguugcuucugaacuguauuagaaacuuaagcaacacguuuucuucuguauuagaaacuuaagcaacauguuuucuucuguauuagaaacuuaagccacauguuuucuugaguucugaacuucagcacagcauuaaaucagagacgagcuuuucuuucuuguuuuuguguuuaaguuuguaacggagcugaaguguggauagucuguguguucugcuuguggcuggugugugaugugcagcauccuugaggguuucagccuugaauuuaugggauuugguacgagucuuaggagguauugugggaauauugaauucuuggacuccccugguugauuuuggaaaauugguaguuaguguaggaaaaacucuacauuuggcaucaggacgcgguacugggaagaagaaaacaugaccucaaacuguuuguguaagacaccagaaaagauauggguagcauuaagcuucaucacauaaauugggacaggcucagaucugaauacaagauuggccuagacaaagggaacugcccauagcugagcucuguacuauuuaguaggugagguuuaggagcucacacuguugcccaggcuugacuugaacucagagcaacauucccgccuuagugacuuggaacgcagggauucuaggugugaggcacuauuccuggcuucuggguguuagcagacagugaagggaggagguccagcaaaagacaugaggcuggauuugcagaucacagagggagggcacuggggccuguaugcaacagcagaggggcucuggacucugcccuucugaguuggugauguguuucauguggacuaggccugcuucuuucucuaugaggcaaucugagaggauaaugaggaaaaucauguuuauuucaaaguuuguguuguauaaucauguuaucuuacugagaaacuguugguggcauaaacgauaaauccacaauugauuucugggcuuuuuuguuuuuuugucugauuaauguggcacauucugcauugaguacacaguugagggcagguuuauuuguagugcucuggaaagcaguguggcugcuccugcuucuagagaauauguacguguuuugcuuuugagacucacuauguagcuuuggcugaccaggagcucgaucugugugacaggcuggccucaaacuugcaacaguucuguucugccuccugaauucuaggauuucagggaugccccaucauuccuggcuuuucaaaguggguguuguugguuuuagggaggucacacauagcacagggcgcucucaggcucccuugaacuguagcuggagauggcccugaacucuucccccuugguuuuuggagacaggguuucucuguguagcccuggcuguccuggauauacucuguagaccaggcuggccuagaauucagaaauccaccugccucugccuccacgagugcugggauuaaaggcgugcacuaccacacccaaaugguccugaacucuuaagaacucccaccucuacuggauuauaggugugcaccaccaugcacagcuccuuuuuccuuuucuggaucugugugcgggguaguuuauagacaagagucucaauguagcccaagcuggccuugaacuugaagcaaucuuuuugccuuuuucuucccuccccuuugguacuggagaucagaacuagguagggccucuuacaagcucuacuucugagcucuguccccaacucccagugacuugaucaggagugguucccuuucuucauuaguugcaucaucaaauaguagcacauuaccugggacacagaacaacucagucauuauuacuguauuuaguaaaguuauaguggccacaagauuuguuucuucagcuucuccagcacauacauuuuuuuccagucauuugugguugucuucucccucuuucuguucuguguaauaccaguuauuucauuucuuuguuagggauucucuuuguaguccuggcugcccuucaauuugauguguagaacagguuagcucaaaaggauuuucuacaggcaaaugggcccgugagucaaaauagaaaaguaaucuugggcccagaaugaggcccauacacacucuuacucuggcaaagaaagcaccaggggccauugagaugggaggggccauugagaugggaagggccauugagaugggaggggcuugcugccaagccuggcaaccugaguucaauccccaggacccaaugauggaaagagagaacucaacuauuacaaguuagcacaaacugaccuccagcuugguaguccuccugccucagccuccuaaauaacugggauuacggguguguacuaccaugcccuguugaaaacuacacauguauacacacaaacauuuggcaguguuggggcuugaaccuagagccuuaugauuuuauaaggcaagcauacuuccacugaucuauagcaccagcccuuuacuauccuaguagaugcauucagcagaccaaacugaaagcaagccauagauggaacaguaccaagaguucauuuauuauugugguguuagagaaccaaaguguacacugagaguucauuuuuuuauauuuuuuauaucuuagaaucuucagacauagaaggaauuuucaugaaaaacaccaugauauuucuaaucuuucucacugucagguuaucaaaucugauaaaaaauaaucauguauuaagccaugaaucagaaccaggcacacagcaaagacaucuguguggcuuucucauacugcccugagcaguguuagcaauucagucacagaauuauaccauauugaagacuuucagucaaacauguaagauugcugaaauggggcuuggcgagauggcucagcagguaagagcacugacugcucuuccagagguccugaguucagaucccagcaaccacaugguggcucgcaaccaucuguaaugagaucugacgcccucuucuggagugucugaagacagcuacaguguauuuacacauaauaaauaaauguuuaaaaaaaaagauugcugaaaugaagaaauaucugcaguguaaacgagacagaacugguagguaaggguucagucuccuccaguguguucucaaaguggugacugccuucccgagcuucagcaagaaaacagucugcagaguagaguugaagucuuccuagcaguuggugcaugagaaauagcaugcagcuucugccacucuaagggcgcuuucucaggaagccacuggacagcauacacuggauacuuaaauccuuccacggcugaaaugaacucaguauugccaucugcauugguuguuaagacacugaaaaacuucuuuaacuuuucauuuucuguaaaguucuucagagagacucuguuugugaaaauuugcagucagauuuucuuuucuuuucucuccucuucuuuuuucuucuuuccuuuucucuucucuucucucuuuuuuuuuuuuuuuucgagacaggauuucucugggcagcguuggcuguccuggaacucacuuuguagaccaggcuggccucgaacucagaaauccuccugccucugccucccgagugcugggauuaaaggcgcgagggcgccaccacgcccggcuuuuuuuucuuucuuuuugggauuugaacucaggaccuucggaagagcagccgguacucuuaaccacugagccaucucuccagccugcagucagauuuuccagugcuaaugaauucaauaacucagcaggaaaauucuggaacauucugcucugucuuguaccugcagugaaguucaagggcaguuucucugacuuaguguuuguacacguuaguaaguucucucugcuaacaggacaggaagcuccucaguagccuccauuaucauaacuauagccuugcuggaaaauauuuuggccacucaggaauaaccugaauguguuagguuagcaccuccaggaaagaggugauucuaaaaagucuucauccucugcaucacuaagaucgagccuuaucuuagcccaugauuguaagccuagcacccaggaggucgaggccgaggcaggggcugggccuccauuuuuaugccaacuuaaacaggauccccaucuuggccucugguaaaucacagauuuguagaauaacugcauggaauaaaggaauggccagacguagaguacaguguuuucagccucaggaaccugagagaggccagaggaccagaaaugcauguguuugguauuuccugggaaugugaaugggcgggucugucugucugucugucugucuauaucuuuguuuguuuauucauugagugauugauuggaacaaguacuuauuguguaguccugccuagccuugaacccagagugcugggauuaagucaucaagccccacaaguggucagauugcuaacugcccuuuuuguucucucaggcuccuggguagaacugcacuucagcaauggcaaugggagcagcguuccagccuccgucucuauuuauaauggugacauggaaaaaauacuguuggaugcccagcaugaaucuggacgaaguagcuccaagaguucucacugugacagguauguuuucuggguaucuccuacaguguugauguuccuaguagauggauaaucacaauugugcauguuuuuguggguggguugccaggucugaggccacauuugggaguaacuccauuauacaaggaacucuggagucugcugagaggaagugaucuggggcucaagucuagagggacuauauuaaaccuagagacaaauaacaaaagucugcccccuuuuugaagcuguucacugagaacaccaagucugagcaguuuuguucauguccccagcuggcuucgguuccuaggcagcacuacuagggagcaaauccaagguguguggcugagagucaguggucaaaggucagaugcuugcaaggguuaugcuaccgaucaugcaggaggguggggcuucccuagggacugucuagcuggcuccuaugugaucagcucagaagacugaggaauuguuuggcacuggucuggugauaggcaaaagggaagagacaugcuuuggagagucucuaccacccccuuaaugagguaagagccccuuggaauuuaugcugcuuaugacacaauugacaugcugcuccguuuuauccguuucuuaaucaagcccaccucgcucccagacaccacaagauaccaacagagcugaaauagacagccacagcuuuggcgagaaaaacagcacucugguaagccauagauaggaacaugcuauaagauucagcauaucaugaguccgguaacugacuccuagacuugcaacauaugcgagucuuuguucucuuaguuuuugaggaaggguaucucauugaacauggagcuuaccauuguguguagaucagcuggcuagugagcuccagugauccuccugccucugcuccaggccugggguuauggaacucaccacucacugugccuggcauuuuacaugaguguuggaucugugguuuuuaaaguuuuuauuuauguuuauguguguguuuguuugagagaaugccauauguauggaggcauuuuaaaccccauuuuuuuuuuuuuuaagacagggaauucccuauucacucugucuagccuggaauuugcuauauagaccaggcuggucuuaaacucacagaaagccuccugccucuguccccugagugcugugauuaaugaugugcaccaacuuguccacugguauuggggguccuaaugaacugaggguccuaaugcucgugcagcaagcauuuuauuuacugagccaucgucccauccaccacuuucccuuaauagaauuucuaaaaauuuaaauugugugucugucugucuguaugcuaugugcacaugagucuugguguccagaagccaaaggcacuggaauuagaauuaacgggcagcaguccaccaacaggucuggguuaugggaacuaauuuggguucucugaaagagcagcaaguacucuuaaccccugggccaucucuccagccccagacagcucauuuaaaaaaauaucuuguagaaauuaauuaauugaggaaucuacuuugccuagugcuaaggugguuacaaauacguacaacuaugccuggcuuauguagugaguguggggcuagagcccaggauucugggcaagcauucuguaaacugagcuguaccccaguccaugagcucacuuuucuaauauuaacucaguagaaacuaaagagcaccuuuagcauuguugugagaucagggccugucuuagucaguguucuauugcugugaagagacaccaugaccauaguaacucuuaaagaaaauauuuaauugaaacuuguuuauaguuucagagguuuaguccauucucaucaugguaggaaacauggcagacacgugguacuggggaagucacugaaaguucuaugucuggauuuguaggcagcaggaagaggaagagcuugguuugggcuuuugaaaccucuuaacccauacagccagugagacaccuccuccaacaaggccacaccuccuaauccccccaaggaguggcauuccuaaguauagaaaccucuaaguguaugggggccauucugugauuuaucuauagggacccauccagggcuccaacagcaucccuauugggcacugauagggauccauccagggcuccaacagcaucccuacugggcacugauaccucaaguaccacuggucuucuggaucauauuuauuguccaagucguagagcagccuggauccguugaagaaccuugugcugcagccuccauucaaaguugggcuggguuaaucauauacccaagagaagaaugugccauuuccagaauucuaauagauaggccugcuaaacauuguguucuuucuuggugcaguuucaucuuagaaggaauaucucaaaugccucauaccaccagacuuacacuucacugagguagaaagcccuugaauuauuucuauucucugugcacauauguguuacaaguccaaaguaguuaguuccuacccacuucucacuucauccaaccagcauaaugucaucaauagagggaaucaguguacuauuuuguagaagagauagaugauuaagaucccuucaaaugaggucugguauugggccuuaguggaaacugaacauuugacaaugggccaccaaguuaccaugugacccgagcugccuaucaugaguggaauguuauauggcccaccaagugauuguguacagcaacaauccacuaucaagugaaagggcuaucuauauaucugaucagguccaaguaggucccgaaggcacaagcaaguuacauggccaaaugcccaugguuucuauuccuugaacccauggaucccuaacaaugguauauauuuuguuuguuuguuuguuuuguuuuucgagacaggauuucucuguguagcucuggcuguccuggaacuuacucuguagaccaggcuggccuugaacucagaaauccaccugccucugccucccaagugcugggauuaaaggcgugcuccaccacugcccggcaaugguauacuuuuuaaaucagcauccaauauaugguauaguuucucucauaaccagaauccauggguucaagaaucgagggguagaaaaaggaguaguuacaacaaucaccccuagugacccacuaggaauuuauuugcauucuguuccuaugaccuuuuucuacuugccuaggugugugugugugugugugugugugugugugugugugugugugugaguguugggggugggggaacuuaugccaggugucaaaacaaccauuccauuggacuggaagcugaguuucgggugcccuuaaaugaacaggcuaagaaaggaaugacaguuuuaggagggugauugauccagauuaccaaggggaaauuggauugcuucuccacaauggaggugagaaagauuaugucugucuggguucaggagauccuuuagggugucucuuggugcuaccauguccugugauuaaagauagugggaaacuccaaacagucuaaucuagguaggaugacaaagugcacagaccguucaggagugaaggugugggucacugcccucagugcuugcugaaaguggaggaaauauauacagaauggguaguagaggagguagcuauaaauaucagcugcuagggucaugugacccgguguacaaaugaggauuguaauugugcaguguuucuguugcguuuuguuaaauguguuuauacauacagauuuguguuuccauuacccauguaacggaacaucaguuaagagaauaucagugguuaucauauuuuauuuugagauauuaaaagaauaucucugaggggacauuaccaccuaaaugucuuaauuuguaaugcauuugaaguugugggauaguuaauaccaugucaggugggguucucuguugagcuuacugacuuugucuuucaugugacuguggaaagcucaccuacuuuauuuaauauuuacuuuuccuuagucugaggaagauuauauugagagaagaagagaaguugaaaguauccugaagaaaaacucagauuggauaugggauuggucaagucgaccagaaaauauuccccccaaguaaguccguuuucacuauucuuagucaagguuuuuccuuuaacaaggggacacugauuggcaguuucuuucuaccuuagggaguuccuuuuuaaacacccgaagcgcacagcuacucucagcaugagaaacacaagcguuaugaagaaagggggaauuuucucagcagacuuucugaagguuuuccuuccaucucuguuacugucucaucugcuggccauuggcuugggguaagugauguuucuaugagagcguggacacccugugacaggguagaccugggugagucuaggccccagcaaguuauuucuacauuguauggagagagagaugauuuuaggccggugcauuuucacaaacuuauucccaagucaaguaaaaaucccguguaguggaaggugccuuuacccaccaugccuugcgcaggguucucaugccgggccucugugccgccuuuagguuucugcuuuuguaucuaguuuagacugaaacagaccagggaguauagcuauggauucuuuagaugggacuagugcuaaagagcaggucaucaaagggacucguauauucugugcuggccucgcagggaugagauuggguuucagaucuuccugugucuaccucccgagugcugagauuacagaugcugcccacccagggauacauaaucucauggucccgcacucuaccagcugagcuaaauucccagcccuuucucuucuuuaagccaauccauacccuccguccacgcugggguaagcucacccucuauaugaagacaguguugggugacugcagucuauuggaauggcugggaugccucuguaggcuucuggucuguguuaguuggggguauguuuggggcagaagaggcucuguagucugcauauucuuuuccccaaaagcuguucauguggcggaugcccagucuguuucguguuuaauuucuugggauguuguggguuucauagguacaucccaguuuucccugcccuuaacuuccugcacugcagacccucagugucccuauagagcugccugggugccggacgccccucuuagcuuacuggguugcagcccuaccugccuguaccacuucucuccuggcacuuggucucauggacaggugcauccccaucaccuggaacccuuugcuugcuugcuuucucucucucucucucucucucucucucucuuucuuucuuucuuucuuucuuuuucucuuucucuuucucucuuucucuuucucucuuucucucuuucucucucucuuucucucuuucucucucucucucucuccuucucucucuuucucucucuuucucucucuuuuucucucuuucucucucucucucuuucucucucucucuuucuuucuugacaggguuucucuguguagcccuggcuguccuggaacucacuuuguagaccaggcuggccucgaacucagaaauccgccugccucugccucccgagugcugggauuaaaggcgugcgccaccacgcccgguuuggaacccuuuucucagaacuagcaagcaacaggguucaguggccguuggggaacauagguaggggaaucucugaauuacaggccagccaggguuacguguggagaccuggucucaaaaaacaaaacagaacagaaccagcaaagggaaaccuguggacagggccaggaaccuguguucaguacaagcugaguuuucccuucagggaauccuugcuggauauaggccuaucuaccacuucuguccuucauccuucccaggcucagaacuugaugccaucccacccaagaucucuuggcaacuuccauucuuucaugaaugcuacccucuuuaguccagauagcucacugcccagucuuauuucuucccaguccacacagaccuggccagguaggauucucuccugucuccuuuccugagaucgucaguucccaccucacugagugcagaaaagggaggcuucauuacguauuccuugguugggcuuugagguuagagguaaugaacuaacuggauaugaagccagccugccugcagcuguguggugacaacauuugacaacacagaagggaaugcaaagcuguauggugauagaauauggguuugguuugaacuuauauuugaaccugggaccuuguacaugguagacagguacugaguuucaacuucuguuguuaauauauuaguaaguuuuauuagaauguuugaaacaacugaauuuaaauuuuaaguaagaaaaauuagaccaauaugaaauacauauuagaugacuaagaacacuuguuaaagauuguagacaguugugcuggaaagauggcucagugguuaggagcacugcuugcucuuguggaggacuuggguuuaauucccagcacccacauggcaauuuauaacuguauaacuccaguucaagaggaucugauacccucacacagacauacauguaggcaaaacaccaaugcacauagaaauaaaauaaaaaucauaaaaaagagaagauuacagucauacuuuaucaaguauaagguggccaguucccuuccaaaagcuguaaccaugguggccuggccccuuugagcuuuguaaagucaccugagaauugugagaccugauuggcugccaucccuuuucugucuaggaucuacauuggaaggcgucugacaacuuccacuagcaccuucugaugaagauuuggaucugacuucuguucacacagugaggauucaugucugagcugugacagcuaauugaagagcuagcaugguccuuggguguuugcacuauguguguuaauuuguucuguaaaugcgguguuccugauuuagugagacagaauagacucuugucaugaccuauaauuauaccuaugggaucaauuaauaagcaugucagacugaugccuauuguagcauuuacuaguaaauuucuuugaauauuagauauaaauaguaaauuucuuugaauauuagauauaaauaguauaaauaauuuuaauauaguagcaaugguguauuuaaaacugaucuguaaucauaauccaguuaagacacuuuacacuucaaaagaacaaguaagugauauuaaaaucauuaaaggguuuuccccaaaggaauauuguggccuuauaauccuauuacauagcagaaaauuaaagggugcgugcggguuaucuguaaaggccucuaacuuugugaacugaguagcaaguagaagcuaagguuacccacgaaccccacuuugcaguucccccucguccugcuuugcaggaugaggauucucgccuugcuguccaccauuaccuuggguggucaguuuuguugcaggcaccuuuaucacucugcugaauucucuuguuuguauuuaaaucuuaugugcucugaaaaucagcugucuacuuuaaaagacuggaaaugaaaaacaaaaucuuugccaaauccacuggagaauacuauauuugcauauccauuaaucaggauccaaagcugcuuaaaucgggcguccucccagucuucucuuuucuauagcaugguuuuaaagccugccuccuugacaugcuguauauauccuguuguauuuguuucacugucccacacuuaacucaggugugcuaaaauaaaagugacauuuuaacagucuuuuguuuauauuuacauaauuacuagacauagccuauaucccuuucauuuggagcaagauccuacaggauguaauagucaauagguguuuucuugcuucauucaguaaaguauuuuuguaagaaauua

SEQ ID NO: 12403 - RNA, 18648 nt, Mus musculus
augccaaguuuuuauacuaaguuuauuucaugcaagaaaugauguuguaguuaaagaugccacuuuaccgaucaacaugcuagauugcccuagugcaucgccugccuggcgacgggcgugcugugcugcccucgugauaacuuaagggccgcugcagaaagcagcaccugcacuacaccuucagcagugaugagguggacagggcgcacacauggaggggccccaaggguagacaucccuggucagccuuuccaaaggcagccucggaggaccacuguccaggccacauguuguggucugguucauguuuguaaacguguuggagcugucuucaggcaugaagucuugcuggacauaggaugaucugcugugugacuuccccaggugaagaagccauagucuuaucuguccuguccauccagcuagaacagacaagaggucaguuaacaucacacacagagccagcaccauccagcuagaacaggcagaggucaguuaacaucacacacagagccagcaccauccagcuagaacaggcagaggucaguuaacaucacacacagaggcuagcagauccuagacauggaucagucauugagguaaaaaauauuuuauggaacaaacuuuugucuuugaaaugaauaagaaaagggaacccagaaggccuagcacaaaacauagacuguuuucuaauaaauggcaccugcguacauucagccuuaagaaccaagccuuggaacaaaaagaugcaauacuggugguuacaucucaucuguggaagcaguaaaugccacggcuccuuaauaugccaggcuucucuuugguccaguuucauuaagggcucaggcuaagcacaagaggcugggagcuuuugacaguuaaagugagaccacagacccagagccacauaacaucagcugugauauauucuggugagaccugggcagugcagcaccuuuuuauaauaaucacauauaaccugguucucacaggagauuauuuccugugauucacagguacuauaaaaccuagagcaguguucccaggcuuccuauucccaccggcuauacuagauaauggcacugauuaacaaaccauuucagguuagcucugucccaugcagggagcagagaaugucagcuucucagcccuuccccuccccuaggucccagaaccaugucccagcagagagcuguagaguaggaagcaaaagcaauggucuguaggggcaccacgcuccuaaacgccagccacgcacugagggcagugaccagagaggaugcacucugucggaccggccagagccacuguaccuugccacguucccgcugcauaagauccagcaguucuuguguccaccccaggagguccaccagccuuuccacaccaugaacuacauccccuagcuggaccacaucuuuccuucgaggacucagaacgaacggccccaccaagucucgauugaugagcagucggggcacugauuucuguacugcuucagacaagcuggcaaaaggcuccaccugaaagauaacccaaaugugagaggcagugugaccaugcacaucaggacauugaacacuagucacugacaccuuggggcaggagacugacacaaagagccugccacuuaguuuacaaaggcuuuuacccccuggucgggugaucucuuucccauccauagccccucucuucugcugggugggccaauacaagcucugacuucuccccacacuccauccuccuccccugucugcauguucugcccgcaagcauuguccuucuaccugcucuguccacucuacagccggggcccugcucugagccuccccuauacuugccugacaaagaggagcaaguacccuuuaucacccugcuacugucccacuuccuggguccccaucaguguccuauuucugcaccaagaauaacgguggaaaaugaguucauuaaggggugagaucaagccuggcuccuaucucaaagggaaaagucaguucuuaccuuucacuguggaacuuugaaagggauuuuagauuuaagugugaacaaagcagcuguggagccaggaugauaguagcacagcucuaaucccagcagucagagacagaccgagggucagauguucaaggucauucucagcuacacagcaaauugaaggucaucuagggcacauaagacccucaccucaaaaucaaaauaaggggcuggaaaaaugucucagcagcuaggagugcuugcugcuggguuuggcucccagcaaccacauggcaguucacaacugcaacuccaguuccagagucuucaauauccugugcauagguaccagauacacaggguguacacacucacauacaucauacacauacgcaggcaaucacucauacauauaucuuuuaaaaugaaaagcaaaacaagucaaagagucuuaacagcuccuaaacauuagagaaggugccgauagcgcaguggguaaggcgccaccaaaccugacaacccaaguuugaucccuaggaaccagaauggaaggagagaacugacucucacagacuguccucuggcccacacagacauauaaacaaauguaaaagaaaaguucuuaaaaauaaagaaaaacuagggcuugugggugugaggaggaaaagguguucuagacgugaaccugaagugagaggagagaggugacuucggcacugccacccugacaucuacauaaaacugcugugggaaaguauggugcgaugcuuuauacacauuaauuacguugcuaauuacagcccugagagaaacgggcgagugauucaacucugcagaggaaacaaacgguacauaaacaugagcaggaauauaaggccccacagggucuguggcgggagcugacccaggcuuagugcuugcuaggcaagcaacccaccaagccacaucaccagcccugucaugccucucuguaacuguucagaaugacagaaaacuaaaugggucauuuucauauuggugacaauguaagcaacuggacccucauacaccgauaucagcauuuguccagcaagaggaccugcauagguguaaauacacacauggacagucaccacggcagacagcacacaaauuacuguuugucuacuguccaccaauaagcaacggccuacauacauugucuuauagguccacaauucuugacuuagaaccuaugacuggaaauguugcagaguucuggcuaguucagauuuaaguuccaggacagccagggcuauacagagaaacccugucucgaaaaaagaaaaaaaaaaaaaaagaaaagaaaagaagaaggaggaggaggaggaagaaggaggagaagaaggaaggaggaaggaagaagaaggaggaggaggagcaggaagaagaggagcaggaggaggaggagcaggaggaggaggaggagcaggaggaggagcaggagcaggaggagaagaaagaagaaggaagaagaagaaggaagaagaaggaggaggaggaagaggaggaggaaggagaagaagaagaagaggaagaagaaggagaagaaggaggaggagaagaaggagaagaagaagauuauaugauuaagugcuccacaaucuaaucuaacagguuacuauuuuuucugcaaauauaggauccaggacacugcagauuuguuaccccacacugguaguggauugaggccuggccugucugugcccucacacucacaggacacagcacuagcagggcacuagcaaggcugcuccaggugggugcucacaucacccaugucacaguguguggccucugccauuuguccccaagaaaagacaccaaugaggauguaggccaaaauauuaguagcuacuguucuuuaaagcugauucuuuaaaggcucuggagagauaggguacgcugcucuugcagagaaacuggguuugaaucccagcaccuacauggcagcucacaacuaccucucaguccaguuccugggaaucagaugcccucuucuggacuccacuggcaccaaaaauacaugcagacauaacacccacauacauagacuaagauaauaaaaacugacagaauaaaguugauucuccacuuugucucugcugcuguaaacgagacauuugguugguugguugguugguugguugauuuuuugagacagguuuucuuuguauaguccuggcuguccuuccucugccucuaaagugcugguggcagucaccacuaccuggcauaaaugaguagaagcauaugguuggcaggcaguggugguauacaccuuuaaucccagaacucugaaugcagaggcggggguggggagaucucugugaguucaaggccauccuggucuacauagugaguuccagaauagacgggcuauguagaaagacccugucucaaaacaaacaaaaucagaugguacauuuauaaguaaggaaaaauggcuauuuucauuuuacuucaaaaauaaaggugacugacagucucaguguccuuaucugauagcugccauaaucagaagaacugggcccauauacugaguaccacagaccagagggcccaacccuuuggccccugacugccccucuacccccacccaagucuguccuuccuuccaaaccuguaucuaugacagcacucuggaaucuucuacuugcucaccuuucacccaggucccuccugacucuacuucccacacccacauuuugcuaccuuauccuuuaggguauuauaccuuggcuaccagauaccuuuguaagguauuuggcugagcugguauccucaaacccacaugauaggaacagggcacacacacccuaguucugugguagcucacucucuuccauguccuacgugacauaguacccucugacuuuacacccacagucauggccccugcugauuuaucuagccaccugucaggaccauccaaccccagcagcaagggacuuugcugaguccugucugaccaauccacagcacagcccacaggagccuuuucagcagaaagucagagcaucagaccucccagugggaucuccauggcccuggccucacugcuaccacuguaggguaccccaccgaaccuuaagcagaaagccuuaccacuuuauugagacccacugacaaggcucacacuaaacagcugcauugcaaugucaccccuccacagcccaugcaacaauauucauuuacucugacacguccuuccguacacaccacccacaauggugccuuaguuuugaaucucacguuaguggucuaaagcaccagaccggccuguucacaucacgcagugacaguggcaggcugagugcacagaccucagccucugcacagcuggccuccugaacagagcuuuuuggaccuuuugccccuaugucuacacacagaugggcuccagcccguggucuugccucuuuacaccuuuuggaaacucgcuggcauucugacucagaugcagaucaguggucaucuccauacagagccacagacauaccugcaugcagaccccaacccuacugguccucugacugccccguaccagcuaacugcugaugcugcagccaaccuccucccaccaaaggucacuucagggccgccaugugcucuucaucccauaguacagcucugugccgagaucaguccuuucagcccugccccauggcuaaccuuucacuacacccuuacgcccuccuacacagccauuguccucaaacccuaagugucaccaccagugacucuccucaccugaaaaggugacaccgucaaccaggcccuagcccuccacaccgcccuccuacccauccccacaugccuuucaacaaaccuccagggaggucccaagaaugaguagcagaucugccaaagcgaagucagccauauggaguaggaaccuugcaggcagcugcuccccaaagaacacaaugucggguuucacaacgccaguacagacagggcagcggggcacccuguccgccaucacaucagccuggggaaucagaagaggguugggggaggaagaugacuuuuaaaagaggaaaacacaaaagcucuucaaggagaugucgaacagguccaaaaaucuucacucuguaaugguccccauguggcuuuaacaauuucugucaacuauuucuuagauguggggagcgggggggggggggguugggggcugcaaauauuucaaaucaaguccuagacaucaccuaguuuuacccacaaauuuuccugugguugcaccugggauggaccacagcccuagagugcuuuguaggcgucuugaacacagugggaaaggcagcacaggccuguccccaguuggagcugaagugaccaguguucugcuucuacccuagaggucagcuacaacucacugaugacacugucaggagugaccacagcugucacaggcagcuccuuacagggaaaguagaugacaauuacuaauaacugacccuagaacaagucucaugccaaacagaaaaggaggcaguauucuuucugacaaggccacagaaacaucucguaaaauaaaguuuuauagcuagcuaaguagauuuuaguagaauaaauucagcaagaaugaguagaaacaacugccaacagaugccagaaaguauuagcuacagaagauaaaacuauauuguguuuaaaugaaaaggggaaaaaauggccaacuuaagauaucuaggaaaagaaaaauuuuaaauguuauggauuauuuuuaaaaagaaccaaagauaacuuuucuccucuuuucucuuucccuccuaaucaugggaugagcacuuuuguagcacgcucucccaucauaaugcgcuaccuugucacaggcccaaaacaugagccagaaucccugacacuggagucaagauaaaccuuuugucuucuaaguuuauuaccugagguauuucuugugguaacagaaagcugauguagccauucuaaaauguguuaaaauucacauugcaugggcuagagaaacauccuagugguuaagagcauugcugcucaugcagaggaccuggauuugauccccagcacccacacgguggcucacacuauuuguaaauacagucccaggggaaccagugccuccuucugaccucuguauauaauacacacacauauauguauauauguguaaaauaaagacuuuuaauucauauuuccugacuuuaaaacuugcuacaagcuacaauaaccaagcagugugauacugguacaaaaaaaagacagagagaucaacagaacagagcagagagcccacaaacaaaucccuacauacauaaucaauacuuuuuuucaaggauaucaagccuauuguugggggaggggagaguauaguuucauucacuauggaagcugggcauggagguacauaccuuuaaucccagaauuuaggacagagggacaaauggaucucuguaaguucaaggucagcguggucuacauagcaaguuccaagcuagccagggcuacauagugagacccugucacaaagugcauuagugcauuaggggaacccgugggggaagcuggagaaacagaaaaguuaaaaguacuggcugcucuuccaaaagaccugaguucauuuccuagcacacacaugguagcucacaaccugcccauauuccaaugccaggggaucggacacccucuucuagccuccuugggcacuguacacacacacagggcauagacaugcauccagcuaaacacccauacacaaaaaauaaauaauaauaucaaauuguaaagugcuaaaaacaguagauaggugcauugaaaagaugaauucuguuaagagagaaagucaccguugagcagcacuguuugugaggccuuaaauggagcauguggcuuuguaaaggaugagcuguggacucaccagcauaugcagaccccaugaacuaugccaaacaaggcuucacgugagacaguucaccccucacacaccugucacaaccccaaaauaaauccucugagauugagcuaugaaaacggccaccaucagacaguauacucucuacuuccugaaucgucuuugagaccauaauacuaaaaagauccaaagaaguucauggccagcguagucuacagaaugaguuccuggacagccagggcuauacggugaaacccugccuuggggguggggacaaucuccaaauaaauguaauucuuuguucuaaaccagacugacuucaucucaacuaggaaguuggaacuguguauguauuguacacaaaaacauaauucaaaauggaucaaauucauaaauguaagagcuaaaacauuuaaacccugagaagaaaacacaagagaagcuaugauagaugccaaaagcccagccaaccaaaggaaaacaacccgacagcauuaaagcuccgacgcucugugacacuggacaaagucauuagaguaauagcagugcaggagcgggagacaauguaaguggaucgccucuucggaaagcucaaggaaaccucagaaaaugaaguuagguuuaccauaaacgcuuacaauuucaugccuaggacuauaacgagaagaauugaaagcagggucucaaaggguugucugcacaccacguccacauucuccaugaccaaaagggaggagcaacacaaguacucauuggcaaacagauacagguuuaaaacgugcccaacuuuaaaaaggaaggggagucugacuaggagauggguaaaucugaagacaguacaucugaaacaagccagucacaaaagaauguggacugagugacucuaugauccaguacuuaggugauaauagaaggaacauaccacaggcuuacgggaagcugguguuuaacagcuauggaguuucugcucgguaugauaaagauuauuuuggaaauaauggcaguacugguugcagaacauugauaccuugcaacuaaacuuaaaaauuauuaaacugggaacuggagagauagcuuaacagcuaagaguacuuguugcucuugcagaagacuuuaguucaauugccaucaccuauggcagcucacaacuaucuguaacuccagucucagggcacccgaugccuucugacugcuaugggauccugcacccacguggacauaaauauauacacucaggaacacacacacauauaaaguaaauauuuuuaaguuauuugaaugaugacuuuuguguuauacauaccacaaugaaacaucguaaagauuuuuaugaggguuuuucugagagaguuucacuguguagucuagguuagcucugagcucauaauccuucaucuucuacgccuuaagugcugcaauuacaaauauacaccauaauagcuaggaaacauauuugaaaugugaacaaaagagcauguguguguugguuguuacuaaaagaacacaaggagcuugugcagcccugaucugggcucucuuggcagugcugugcaugacccacgccucucagugacccacgccucgaagugacccacgccucgcaguggcccacgccucgcagugacccacgccucgcagaaacagcgcaagggaugaagaagcagaacuuugacucaguucaucacggugccggguggcuccagucauggacaugggaacgggugccgcugcuguucgugcuauggccaaccaggaagcagaaagcaagggcagaaccagaagcugcccagccuuccaaagccuacccaggugaucuacuucugucagcgaggccucagaucucaaagguucuacaacuuccuaauacagcacaggacuacacaugggguguucaaacaugcagcccuguggggacauuuuacuucaaacuauaauaacucccaagcugaugaacuagaaagggauggaauagagaaggaaaggaagagacagaggaagggacggaagaaagaauggugagcagugggaaaaacacaaaguaagauggcugaucggaacccaaggauuucaacaaucacaccggccuccacucgggcacugugguacauguauccccuacacccacacaaguaaauagaauauaaaugcaaaauauaaaaguaaucuucaagccgggcagugguggcacacgccuuucaucccagcacuugggaggcagaggcagguggauuucuaagccuggucuacagagugaguuccaggacagccagggcuacacagagaaacccugucuugacaaaacaaacaaaaaaaaacccaccaccaccaccaacaacaacaaaaguaaucuuaucuuuaaaagaauaaggaaguggagagcagauacaugcagaccaagcaccaaccggcugaaagcagaugcaccugaccugacagacuccagcagaagugacuccaauaaugaagaaggaaaaugaccgcuugcaccuggcuagccggugccccagugauauucccugucaaccuugcuggcuguuaggacuuaacuaauugcuaaagcacaucucugggggugccugcaggguguuucuagagaggguuaacuacgugggaagaaccaccaugaacguggguggcaugagcccauggacaaauuccaggaaaucacucacuagauucacuugucccuaauuaaacccuauuuuccagaaagcacucaaaacaagaaauaagaaaaaccuacuaagacaaauaaggcaauccaaggacacaugcuuucucuucaagagagaccacaaagaccaaccgcagggaaauccugugccuagcagacaaagccauguacacuucccccugaaacggccacugagcuucguuuccuccagaauucaacacacugcccugaaagucaugugcuccacugggucucacuguuuccaucuugcccugugguuuugguccuugcucguuuaugauuaauguuuucuagcuuccaggcuucaaaugaugcugccugaaggaugccaacccuugcuaauccccuucuccugggagccacuggaccaccugagagcccuggcccuggacuccauacauuucaccucuccccagcaugcaacauccaccaucccuaccagcugcaaggagccaaugugguuggcuccauguucucuggaccuugcagaacgguaugcaugaauauggacccacuuaugaauacaugcguguggaggacagggguagaugcugagcaccuucucuagucacgcuccacgugugcauguguauguagacagggucucuauguaguccuggcccuccuggaguucaacauguagaccaagcuggccuugaacucaccaagaucugccugccucugccucaagugcugagaguaaaggcauguaaccgcacacuugacuccaccuuaguuuuugaguuuagugugucucaccaccugcagcucaucaguuaggcuaggcugguuugccagugagcucuacagguaugccugucucgaaccacucagccccaggguuauagacauguauacuacuguguccaacuuuuacaagaugguggauguugcaugcuggggagaagugaaauguacggaguccagggccaggggucucaggcgauccaguggcccucaggagaaggggaugggcaaaaaggaucugaacaccggucuuugugcuuagcagagcuaguacaaauaccagcuuguucuaggaaucugagaguccagcgggcugccauuccugccuagcucuucuaugguucaccuacugagccaucuccuuacccuuuccuguguuguuuuaauagcaacaauuauaaacauuaaaaaugccucauauuaaguaacaaaaggaauaaacaugucucagaugucaacauaagauguccauuaaacugaacaggaauguagagaauuuauaaaagauauuuaauaggaaucaaugaacuaauuuuaauauuuuaaugucuauauagaaaccuugcaugcauguuuauauguacauauaucuuuugcuuuaaaaacacagacuauuacauuaucccucaaucacaaaugucggccaaagggauugguuagagagagauucauuuuauuucuucuuccuuucuuucuucuuucuuucuuucuuucuuucuuucuuucuuucuuuuuguuugcuuuuuuagacaaacacuauguaacucuggcuggccuagaacucagagaucugccugccucuugcucccaaguucugggauuaaaggugugcucaaccaugccugccauggggaauucauuuucccuauauauuucugaccugcauuuuugggguggagggagcacuggccauagagcccagggccguuuaugcuaggcaagcacuccaccauugagcugcgucacauucucagcccagccuuauguuccuuuacaaguauguauuauuuuucuaagucaaaaguuugggagccaggcaugguggagcacauccugaaucccacagaagcugauggaucucuuuguguuauaggccaaccuggucuaaauagugagaccuugucuaaacaaacaaagccaaguauggugauguauaauguaaucccagcacuggggaggcagagauccuuaggguggaucuuuaagguugccugaccaaccagccuagcuauuuuggugaguuucagaccucugugagcguccuguuuugaaacaaacaaauaaacaagcacaaaacaaacuauuauaagauccucuacccccaagaauugcagaaggcagagacuauuuccugaggugacucacccauaugucuuccccugggaaggaccuucgacagaccgugcauguagcuguuacaaaggucccgugggcuucaaccagcuuugaggcagggaucccagaugcugaaauucaaagcaaaucucaguguugcagccucugggauggcuauguaagcacacaagcucaccuucugggcuugacaaaacugauuucaaaaaaacucuauggcagguaagcaaacagaaagggaccucucagcugcacgugguggcacaagcacacaauccuagcacuggggaggcugaggcuaaagagcugagagccccaagacagucugagcuacggaguacguuugaggugagugugggcucuagcagaaccuccucggaacaacaaccgggcucucaugaaguucauuacugcucuuugguaacuguacugcuuaaacccaaagccaggaaauuccuaucuuccccuaaaaccuuuccuucugcuuagggggaaacuugggguggucacuacugucucugguucuggguuguagauuccuucucacaggacuccuaucccgcaaugugaugucuuacuucagaccacagcacuccacagaauggcagaguggcuggaucugccaugggccugcauauugcaccuugaggaagcagcagcaccucccccaggguaugcaggcucuaaccauggcugucucagugugaaguagagccaagaugucacugacugacuuggacaacacugaaauguugguggcucuucagaauaauggcaucagagcuaugcugcaacaaggcuuuaucuuccagacauauccauaaacaucuagacauuguuucuauaguagcaccauggugugagguaucugccugaaaauaaucugagggugaaagaggagguggagggaacagagaacaaggccuggccaugugucacacauggaaauggaagaaaggaccuaaggguuccuuaggugggagccagagauggagagaaagugggaggaagagggaagggaagaaaaagggaaggagaaagagauggaaagagaagaagagagagagaggcagagagaggggagauccacacuagauuuaaaauuguaugaauuuuaguuccaucuaaaacucaggacucagaaggugugcaggagacaggccuacagagagguuuccauguggccucaaaugcagaagugguaaaggcauaaccagcugccuagcaacaguccagggccgacauaaacacuaggccguaggcaguccugagaaacaagcacagacaugcaaggggccaaaggcucaccucucucaagcccgucgauguucuguguauagagccgcagaagcagcuccuugucguggaggagccucaggaaguagugagugacauugggccuguagugcccaggguacagcuccuuggccaacaugaaaaagggcuugggguugugaaagaaaaagccaaguucaaagauggcuucaggguacgggaugucauacugcugaagguugcuguagaggccgcucccuggggaucugcagagagaaggaaaaggcugagcccugcagaagacaguggggaaaugacacccaagggaaccgcagcauaccugaaguccgggaugccacugggugugcugaugccggcccccaccaugaccaccacccuacugcaggcucugguccgaagcagcucagcuacauccugcagagaaaacuucuucucacugcuuccuccaccuccaaagccgccugaggcucccacacagagggauaugggccuucucccaccuguaacacugacagcaagagcgcaggagagaggcagcaggcaacagucagucuuaggcuagcaagagugagggcagcuggacucuuccccccgucaaagguggacauggccucuccagugccagccaaacaaccacuuucccaccacgcaugacuaccaacuaaagcacagaaccaucuugcaucaggaaucgagauuuacuugggggcaagaaaauucugauuuacagacagguuugcagacagguucccugaugcuucucaucaucaauggugugagcugaagggcucugagaaaaccacagcugacuggccagauggaacuuuagaguuggaauguugcagauccagagcuaaacuuaucuugagcuaucuuuaguccccuggauaggauaccuaacauccuuuugacuaugaaauaagaccuuuggaaugucuugacuucaaagaccacaagcuuccacuagcccaggagcaaagacucccguuagagcauaucggaagccaauaggaugauuuuacugcugccuaacguucccacugauauucaguaagugagugaauuucugacuaucuuuuguucugagacuagaaguuuguauaaccccuuccauaagugagauuauuucguguaacccgagucuguguuuccagggcacgaucauucauacuggguucacaguaagcuaugcauuauucacuuugaagcaagcaagagcugugccuugugcccauggucuaggcacccagugugagaugcccauggaugauccugucccauccgaggugucaucaggagcagugccaagggccagaacaggccuuuguguccaacugucugugucaccuccuuggauagaguaugagagugcucccugggacccagucuggaccugcuuucguuuagcugaugguccacuggcuuaucugagcacguacuagguggccucuugcuguugcagagcaacuguuagaacaucuguaguagagcguucaccagaaucuguuuuccagcagucucgauuuucucucggcacgccugccuuuuugucucugucucuuccucauugcaaccuggcccuuuuaguuuagaacuccugugggggccuaaucauaaagaugguggagauaagaggcacuugcucucucuaguccaucaggacagaggaaucaaagagaacucccccaaaagcacaacagcuucacugagaagccuaagacaagagauuuuguucccuuggaaggaaccuuauucccagcugggaaaacacacaagagacaaaaucaccccguuuucuggguacccuuacuuuccugcaagcacacaccauaaacccaaaguacaguaggaggaaaugcucagugagaagcaagggggcuacuuccggaaguggcacuuagaacuuagccugaccgcaaagcccaugccggguccuagggaccaacgcgcuaagucacugcaacccuccuagaggucuccugauaaaaacaagaaugagaagcagcagcaagcaagcucuggcuccaacacaccucucacucaucaaauacccuggcgcacagggcacccagggcagugcacucagagguuuugcccuaauauuuucugaacuccucuuaaacacaaaccauaugagaauacaaaagggacaaaagaaaaguugugaccauugcugagugucugccaaccgcuaggcaccacucagggaacauaaaagacauuuuuagucacuuguaccaaaacaaacaaacaaacaaacaguuugcaacugacagacauacauguggacaaaauuuuaccaaauaucuaacaacaaacuuaagauauaacuuaaaguacaucuacaugguauggaaagccccugagaugaagaaacucagagguuaguauucaguucugcccaagacauuguaaaguuacagaggaugaagucacaaaagagucccaaaucuaaaaucaagagaagaaggaauguucuguaaaggcauccuccucacaaacaucccagggcuccuguguuaggguuuaugacagccacacugucuuacagaugaucucauauuagaaaugcuuccacaaguuagagugucuuuucugaucccugcuuuauccucagcacucacgaguaugguagagaaaaugcucuguaaccguagccuaaaugaacaacucuuuauugaaaagaauaaaauguugucacccacaucaagugacuauaccauugucuacccaaauauucuuccauuacauuucuuugcuaacgacugugggcccuaaaacuguaaggacuccaggcuggguguguaguucaguggugccauguuagccuaucagacaauugcaaagccugaguuuguuacucagcacagacaaaaaaaaaaaguccaaauuuguacauuauauugauaaauugucuugcgucauuugagcucacugagaagauggcuuuggaaacaaggccgacaaccccuucccucaugccagacccauguuugucucaaaguccaaagucuggagggcuggcuccccuaacuauguaaaaggacagagagagaacagcaaaacagcccaagagugaaaacacuugugcccuugagaacagaagggaaacgguuuccaguggaagucacuauaguuuaucccaguauaggaaaguaucugcaagaaaaagaaugugcccuccaguaggaaggaaaucccgcagcucagacagagggacagcccaccugggagcuccaaaugacuaucucaacuuucucugccaguuucuguuagauguagcaaguguccaauuugauauuacuuccaucuguugcuuuacuaaaaaccucacugaaagggucacucuguucuggcaaggacucuuuacugggaguuccaccgagcuaccuuaaagauagccaauagacgucugcugacuuuuuuuuuuuuuuuugaauaugcagugugaugauuucucucuaacuuaauauacucacuuauuucaaacugaaaauaucccuauuauugaucacucucaggacucuaugagacauguuacuauuuugcagacaguaugacuguugguaaaaauuuuuaguuucacaaccuuuaugggggacaauuaaaacacaaguaacagcuggaugugguggcaugugacuguagucuccgacgcuuggagggagguggaagcaagguggauccggaguucaaggucauccuccuucacacagccagcugaaggccaguuugaacaagagaccagucucaaaauaauacaaaccacguaaccuuacccaaggcugucuacugagaauuugugguccaaauggggugcaaacacguuuauuuaucacguuauuuguaauaauucaagauuagaaaguauucaauaaggaaauggugauauaaauuauaagacauccauacaacgaacuucuauaaaauauuucaaagacugugcugcaauaguuacauagaaaaacaccuuuaaggagaagguagugauggccggucagcaaaaccuuguagaagggcgcgccugccggguccuuacucccacaauugcuuccagcuacccgccccuaaaacgccgcugauagccuaucugcgagaucccgugucuccccugccguggcucaccucccggaccccacagucugagcgcggccaaugccagucgaccgcuuagcgccaugaugcucugcaggacgacggcgccuagagggucaagcgccauccgaauccccgcccccgugagccaagccccgcccucucggcacucuuacucccgcccccccucuggccaagugccgcccuccggcgccuucccucggccgagcccagcccagcccccgcacgauaacccgaaguguggaaggcuguguuuaugccuggugcuggcagcuucucccucugugggacucugacuuauugguugggaagccaaaccgggagauuucaucguuuuacgccgcucucgaccuccuugaguaggcgggugauaacuaaugcucucugagcgauuugcaucacaccuaguccucgccaaacgccauccgguuucagaggacccaagucugcaggcuugaggcuacgugaccagucaguggcuagcuguccccaggcaccucuacucuuuaaugccucaagggcagggccagaaacccgggagaaguuuagcggaagu

SEQ ID NO: 12404 - RNA, 18648 nt, Mus musculus
acuuccgcuaaacuucucccggguuucuggcccugcccuugaggcauuaaagaguagaggugccuggggacagcuagccacugacuggucacguagccucaagccugcagacuuggguccucugaaaccggauggcguuuggcgaggacuaggugugaugcaaaucgcucagagagcauuaguuaucacccgccuacucaaggaggucgagagcggcguaaaacgaugaaaucucccgguuuggcuucccaaccaauaagucagagucccacagagggagaagcugccagcaccaggcauaaacacagccuuccacacuucggguuaucgugcgggggcugggcugggcucggccgagggaaggcgccggagggcggcacuuggccagagggggggcgggaguaagagugccgagagggcggggcuuggcucacgggggcggggauucggauggcgcuugacccucuaggcgccgucguccugcagagcaucauggcgcuaagcggucgacuggcauuggccgcgcucagacugugggguccgggaggugagccacggcaggggagacacgggaucucgcagauaggcuaucagcggcguuuuaggggcggguagcuggaagcaauugugggaguaaggacccggcaggcgcgcccuucuacaagguuuugcugaccggccaucacuaccuucuccuuaaagguguuuuucuauguaacuauugcagcacagucuuugaaauauuuuauagaaguucguuguauggaugucuuauaauuuauaucaccauuuccuuauugaauacuuucuaaucuugaauuauuacaaauaacgugauaaauaaacguguuugcaccccauuuggaccacaaauucucaguagacagccuuggguaagguuacgugguuuguauuauuuugagacuggucucuuguucaaacuggccuucagcuggcugugugaaggaggaugaccuugaacuccggauccaccuugcuuccaccucccuccaagcgucggagacuacagucacaugccaccacauccagcuguuacuuguguuuuaauugucccccauaaagguugugaaacuaaaaauuuuuaccaacagucauacugucugcaaaauaguaacaugucucauagaguccugagagugaucaauaauagggauauuuucaguuugaaauaagugaguauauuaaguuagagagaaaucaucacacugcauauucaaaaaaaaaaaaaaaagucagcagacgucuauuggcuaucuuuaagguagcucgguggaacucccaguaaagaguccuugccagaacagagugacccuuucagugagguuuuuaguaaagcaacagauggaaguaauaucaaauuggacacuugcuacaucuaacagaaacuggcagagaaaguugagauagucauuuggagcucccaggugggcugucccucugucugagcugcgggauuuccuuccuacuggagggcacauucuuuuucuugcagauacuuuccuauacugggauaaacuauagugacuuccacuggaaaccguuucccuucuguucucaagggcacaaguguuuucacucuugggcuguuuugcuguucucucucuguccuuuuacauaguuaggggagccagcccuccagacuuuggacuuugagacaaacaugggucuggcaugagggaagggguugucggccuuguuuccaaagccaucuucucagugagcucaaaugacgcaagacaauuuaucaauauaauguacaaauuuggacuuuuuuuuuuugucugugcugaguaacaaacucaggcuuugcaauugucugauaggcuaacauggcaccacugaacuacacacccagccuggaguccuuacaguuuuagggcccacagucguuagcaaagaaauguaauggaagaauauuuggguagacaaugguauagucacuugaugugggugacaacauuuuauucuuuucaauaaagaguuguucauuuaggcuacgguuacagagcauuuucucuaccauacucgugagugcugaggauaaagcagggaucagaaaagacacucuaacuuguggaagcauuucuaauaugagaucaucuguaagacaguguggcugucauaaacccuaacacaggagcccugggauguuugugaggaggaugccuuuacagaacauuccuucuucucuugauuuuagauuugggacucuuuugugacuucauccucuguaacuuuacaaugucuugggcagaacugaauacuaaccucugaguuucuucaucucaggggcuuuccauaccauguagauguacuuuaaguuauaucuuaaguuuguuguuagauauuugguaaaauuuuguccacauguaugucugucaguugcaaacuguuuguuuguuuguuuguuuugguacaagugacuaaaaaugucuuuuauguucccugaguggugccuagcgguuggcagacacucagcaauggucacaacuuuucuuuugucccuuuuguauucucauaugguuuguguuuaagaggaguucagaaaauauuagggcaaaaccucugagugcacugcccugggugcccugugcgccaggguauuugaugagugagagguguguuggagccagagcuugcuugcugcugcuucucauucuuguuuuuaucaggagaccucuaggaggguugcagugacuuagcgcguuggucccuaggacccggcaugggcuuugcggucaggcuaaguucuaagugccacuuccggaaguagcccccuugcuucucacugagcauuuccuccuacuguacuuuggguuuauggugugugcuugcaggaaaguaaggguacccagaaaacggggugauuuugucucuuguguguuuucccagcugggaauaagguuccuuccaagggaacaaaaucucuugucuuaggcuucucagugaagcuguugugcuuuugggggaguucucuuugauuccucuguccugauggacuagagagagcaagugccucuuaucuccaccaucuuuaugauuaggcccccacaggaguucuaaacuaaaagggccagguugcaaugaggaagagacagagacaaaaaggcaggcgugccgagagaaaaucgagacugcuggaaaacagauucuggugaacgcucuacuacagauguucuaacaguugcucugcaacagcaagaggccaccuaguacgugcucagauaagccaguggaccaucagcuaaacgaaagcagguccagacugggucccagggagcacucucauacucuauccaaggaggugacacagacaguuggacacaaaggccuguucuggcccuuggcacugcuccugaugacaccucggaugggacaggaucauccaugggcaucucacacugggugccuagaccaugggcacaaggcacagcucuugcuugcuucaaagugaauaaugcauagcuuacugugaacccaguaugaaugaucgugcccuggaaacacagacucggguuacacgaaauaaucucacuuauggaagggguuauacaaacuucuagucucagaacaaaagauagucagaaauucacucacuuacugaauaucagugggaacguuaggcagcaguaaaaucauccuauuggcuuccgauaugcucuaacgggagucuuugcuccugggcuaguggaagcuuguggucuuugaagucaagacauuccaaaggucuuauuucauagucaaaaggauguuagguauccuauccaggggacuaaagauagcucaagauaaguuuagcucuggaucugcaacauuccaacucuaaaguuccaucuggccagucagcugugguuuucucagagcccuucagcucacaccauugaugaugagaagcaucagggaaccugucugcaaaccugucuguaaaucagaauuuucuugcccccaaguaaaucucgauuccugaugcaagaugguucugugcuuuaguugguagucaugcguggugggaaagugguuguuuggcuggcacuggagaggccauguccaccuuugacggggggaagaguccagcugcccucacucuugcuagccuaagacugacuguugccugcugccucucuccugcgcucuugcugucaguguuacaggugggagaaggcccauaucccucugugugggagccucaggcggcuuuggagguggaggaagcagugagaagaaguuuucucugcaggauguagcugagcugcuucggaccagagccugcaguagggugguggucauggugggggccggcaucagcacacccaguggcaucccggacuucagguaugcugcgguucccuugggugucauuuccccacugucuucugcagggcucagccuuuuccuucucucugcagauccccagggagcggccucuacagcaaccuucagcaguaugacaucccguacccugaagccaucuuugaacuuggcuuuuucuuucacaaccccaagcccuuuuucauguuggccaaggagcuguacccugggcacuacaggcccaaugucacucacuacuuccugaggcuccuccacgacaaggagcugcuucugcggcucuauacacagaacaucgacgggcuugagagaggugagccuuuggccccuugcaugucugugcuuguuucucaggacugccuacggccuaguguuuaugucggcccuggacuguugcuaggcagcugguuaugccuuuaccacuucugcauuugaggccacauggaaaccucucuguaggccugucuccugcacaccuucugaguccugaguuuuagauggaacuaaaauucauacaauuuuaaaucuaguguggaucuccccucucucugccucucucucucuucuucucuuuccaucucuuucuccuucccuuuuucuucccuucccucuuccucccacuuucucuccaucucuggcucccaccuaaggaacccuuagguccuuucuuccauuuccaugugugacacauggccaggccuuguucucuguucccuccaccuccucuuucacccucagauuauuuucaggcagauaccucacaccauggugcuacuauagaaacaaugucuagauguuuauggauaugucuggaagauaaagccuuguugcagcauagcucugaugccauuauucugaagagccaccaacauuucaguguuguccaagucagucagugacaucuuggcucuacuucacacugagacagccaugguuagagccugcauacccugggggaggugcugcugcuuccucaaggugcaauaugcaggcccauggcagauccagccacucugccauucuguggagugcuguggucugaaguaagacaucacauugcgggauaggaguccugugagaaggaaucuacaacccagaaccagagacaguagugaccaccccaaguuucccccuaagcagaaggaaagguuuuaggggaagauaggaauuuccuggcuuuggguuuaagcaguacaguuaccaaagagcaguaaugaacuucaugagagcccgguuguuguuccgaggagguucugcuagagcccacacucaccucaaacguacuccguagcucagacugucuuggggcucucagcucuuuagccucagccuccccagugcuaggauugugugcuugugccaccacgugcagcugagaggucccuuucuguuugcuuaccugccauagaguuuuuuugaaaucaguuuugucaagcccagaaggugagcuugugugcuuacauagccaucccagaggcugcaacacugagauuugcuuugaauuucagcaucugggaucccugccucaaagcugguugaagcccacgggaccuuuguaacagcuacaugcacggucugucgaagguccuucccaggggaagacauaugggugagucaccucaggaaauagucucugccuucugcaauucuuggggguagaggaucuuauaauaguuuguuuugugcuuguuuauuuguuuguuucaaaacaggacgcucacagaggucugaaacucaccaaaauagcuaggcugguuggucaggcaaccuuaaagauccacccuaaggaucucugccuccccagugcugggauuacauuauacaucaccauacuuggcuuuguuuguuuagacaaggucucacuauuuagaccagguuggccuauaacacaaagagauccaucagcuucugugggauucaggaugugcuccaccaugccuggcucccaaacuuuugacuuagaaaaauaauacauacuuguaaaggaacauaaggcugggcugagaaugugacgcagcucaaugguggagugcuugccuagcauaaacggcccugggcucuauggccagugcucccuccaccccaaaaaugcaggucagaaauauauagggaaaaugaauuccccauggcaggcaugguugagcacaccuuuaaucccagaacuugggagcaagaggcaggcagaucucugaguucuaggccagccagaguuacauaguguuugucuaaaaaagcaaacaaaaagaaagaaagaaagaaagaaagaaagaaagaaagaagaaagaaaggaagaagaaauaaaaugaaucucucucuaaccaaucccuuuggccgacauuugugauugagggauaauguaauagucuguguuuuuaaagcaaaagauauauguacauauaaacaugcaugcaagguuucuauauagacauuaaaauauuaaaauuaguucauugauuccuauuaaauaucuuuuauaaauucucuacauuccuguucaguuuaauggacaucuuauguugacaucugagacauguuuauuccuuuuguuacuuaauaugaggcauuuuuaauguuuauaauuguugcuauuaaaacaacacaggaaaggguaaggagauggcucaguaggugaaccauagaagagcuaggcaggaauggcagcccgcuggacucucagauuccuagaacaagcugguauuuguacuagcucugcuaagcacaaagaccgguguucagauccuuuuugcccauccccuucuccugagggccacuggaucgccugagaccccuggcccuggacuccguacauuucacuucuccccagcaugcaacauccaccaucuuguaaaaguuggacacaguaguauacaugucuauaacccuggggcugagugguucgagacaggcauaccuguagagcucacuggcaaaccagccuagccuaacugaugagcugcagguggugagacacacuaaacucaaaaacuaagguggagucaagugugcgguuacaugccuuuacucucagcacuugaggcagaggcaggcagaucuuggugaguucaaggccagcuuggucuacauguugaacuccaggagggccaggacuacauagagacccugucuacauacacaugcacacguggagcgugacuagagaaggugcucagcaucuaccccuguccuccacacgcauguauucauaaguggguccauauucaugcauaccguucugcaagguccagagaacauggagccaaccacauuggcuccuugcagcugguagggaugguggauguugcaugcuggggagaggugaaauguauggaguccagggccagggcucucaggugguccaguggcucccaggagaaggggauuagcaaggguuggcauccuucaggcagcaucauuugaagccuggaagcuagaaaacauuaaucauaaacgagcaaggaccaaaaccacagggcaagauggaaacagugagacccaguggagcacaugacuuucagggcaguguguugaauucuggaggaaacgaagcucaguggccguuucagggggaaguguacauggcuuugucugcuaggcacaggauuucccugcgguuggucuuuguggucucucuugaagagaaagcauguguccuuggauugccuuauuugucuuaguagguuuuucuuauuucuuguuuugagugcuuucuggaaaauaggguuuaauuagggacaagugaaucuagugagugauuuccuggaauuuguccaugggcucaugccacccacguucauggugguucuucccacguaguuaacccucucuagaaacacccugcaggcacccccagagaugugcuuuagcaauuaguuaaguccuaacagccagcaagguugacagggaauaucacuggggcaccggcuagccaggugcaagcggucauuuuccuucuucauuauuggagucacuucugcuggagucugucaggucaggugcaucugcuuucagccgguuggugcuuggucugcauguaucugcucuccacuuccuuauucuuuuaaagauaagauuacuuuuguuguuguuggugguggugguggguuuuuuuuuguuuguuuugucaagacaggguuucucuguguagcccuggcuguccuggaacucacucuguagaccaggcuuagaaauccaccugccucugccucccaagugcugggaugaaaggcgugugccaccacugcccggcuugaagauuacuuuuauauuuugcauuuauauucuauuuacuuguguggguguaggggauacauguaccacagugcccgaguggaggccggugugauuguugaaauccuuggguuccgaucagccaucuuacuuuguguuuuucccacugcucaccauucuuucuuccgucccuuccucugucucuuccuuuccuucucuauuccaucccuuucuaguucaucagcuugggaguuauuauaguuugaaguaaaauguccccacagggcugcauguuugaacaccccauguguaguccugugcuguauuaggaaguuguagaaccuuugagaucugaggccucgcugacagaaguagaucaccuggguaggcuuuggaaggcugggcagcuucugguucugcccuugcuuucugcuuccugguuggccauagcacgaacagcagcggcacccguucccauguccaugacuggagccacccggcaccgugaugaacugagucaaaguucugcuucuucaucccuugcgcuguuucugcgaggcgugggucacugcgaggcgugggccacugcgaggcgugggucacuucgaggcgugggucacugagaggcgugggucaugcacagcacugccaagagagcccagaucagggcugcacaagcuccuuguguucuuuuaguaacaaccaacacacacaugcucuuuuguucacauuucaaauauguuuccuagcuauuaugguguauauuuguaauugcagcacuuaaggcguagaagaugaaggauuaugagcucagagcuaaccuagacuacacagugaaacucucucagaaaaacccucauaaaaaucuuuacgauguuucauugugguauguauaacacaaaagucaucauucaaauaacuuaaaaauauuuacuuuauauguguguguguuccugaguguauauauuuauguccacgugggugcaggaucccauagcagucagaaggcaucgggugcccugagacuggaguuacagauaguugugagcugccauaggugauggcaauugaacuaaagucuucugcaagagcaacaaguacucuuagcuguuaagcuaucucuccaguucccaguuuaauaauuuuuaaguuuaguugcaagguaucaauguucugcaaccaguacugccauuauuuccaaaauaaucuuuaucauaccgagcagaaacuccauagcuguuaaacaccagcuucccguaagccugugguauguuccuucuauuaucaccuaaguacuggaucauagagucacucaguccacauucuuuugugacuggcuuguuucagauguacugucuucagauuuacccaucuccuagucagacuccccuuccuuuuuaaaguugggcacguuuuaaaccuguaucuguuugccaaugaguacuuguguugcuccucccuuuuggucauggagaauguggacguggugugcagacaacccuuugagacccugcuuucaauucuucucguuauaguccuaggcaugaaauuguaagcguuuaugguaaaccuaacuucauuuucugagguuuccuugagcuuuccgaagaggcgauccacuuacauugucucccgcuccugcacugcuauuacucuaaugacuuuguccagugucacagagcgucggagcuuuaaugcugucggguuguuuuccuuugguuggcugggcuuuuggcaucuaucauagcuucucuuguguuuucuucucaggguuuaaauguuuuagcucuuacauuuaugaauuugauccauuuugaauuauguuuuuguguacaauacauacacaguuccaacuuccuaguugagaugaagucagucugguuuagaacaaagaauuacauuuauuuggagauuguccccacccccaaggcaggguuucaccguauagcccuggcuguccaggaacucauucuguagacuacgcuggccaugaacuucuuuggaucuuuuuaguauuauggucucaaagacgauucaggaaguagagaguauacugucugaugguggccguuuucauagcucaaucucagaggauuuauuuugggguugugacaggugugugaggggugaacugucucacgugaagccuuguuuggcauaguucauggggucugcauaugcuggugaguccacagcucauccuuuacaaagccacaugcuccauuuaaggccucacaaacagugcugcucaacggugacuuucucucuuaacagaauucaucuuuucaaugcaccuaucuacuguuuuuagcacuuuacaauuugauauuauuauuuauuuuuuguguauggguguuuagcuggaugcaugucuaugcccuguguguguguacagugcccaaggaggcuagaagaggguguccgauccccuggcauuggaauaugggcagguugugagcuaccaugugugugcuaggaaaugaacucaggucuuuuggaagagcagccaguacuuuuaacuuuucuguuucuccagcuucccccacggguuccccuaaugcacuaaugcacuuugugacagggucucacuauguagcccuggcuagcuuggaacuugcuauguagaccacgcugaccuugaacuuacagagauccauuugucccucuguccuaaauucugggauuaaagguauguaccuccaugcccagcuuccauagugaaugaaacuauacucuccccucccccaacaauaggcuugauauccuugaaaaaaaguauugauuauguauguagggauuuguuugugggcucucugcucuguucuguugaucucucugucuuuuuuuuguaccaguaucacacugcuugguuauuguagcuuguagcaaguuuuaaagucaggaaauaugaauuaaaagucuuuauuuuacacauauauacauauauguguguguauuauauacagaggucagaaggaggcacugguuccccugggacuguauuuacaaauagugugagccaccgugugggugcuggggaucaaauccagguccucugcaugagcagcaaugcucuuaaccacuaggauguuucucuagcccaugcaaugugaauuuuaacacauuuuagaauggcuacaucagcuuucuguuaccacaagaaauaccucagguaauaaacuuagaagacaaaagguuuaucuugacuccagugucagggauucuggcucauguuuugggccugugacaagguagcgcauuaugaugggagagcgugcuacaaaagugcucaucccaugauuaggagggaaagagaaaagaggagaaaaguuaucuuugguucuuuuuaaaaauaauccauaacauuuaaaauuuuucuuuuccuagauaucuuaaguuggccauuuuuuccccuuuucauuuaaacacaauauaguuuuaucuucuguagcuaauacuuucuggcaucuguuggcaguuguuucuacucauucuugcugaauuuauucuacuaaaaucuacuuagcuagcuauaaaacuuuauuuuacgagauguuucuguggccuugucagaaagaauacugccuccuuuucuguuuggcaugagacuuguucuagggucaguuauuaguaauugucaucuacuuucccuguaaggagcugccugugacagcuguggucacuccugacagugucaucagugaguuguagcugaccucuaggguagaagcagaacacuggucacuucagcuccaacuggggacaggccugugcugccuuucccacuguguucaagacgccuacaaagcacucuagggcugugguccaucccaggugcaaccacaggaaaauuuguggguaaaacuaggugaugucuaggacuugauuugaaauauuugcagcccccaaccccccccccccccgcuccccacaucuaagaaauaguugacagaaauuguuaaagccacauggggaccauuacagagugaagauuuuuggaccuguucgacaucuccuugaagagcuuuuguguuuuccucuuuuaaaagucaucuuccucccccaacccucuucugauuccccaggcugaugugauggcggacagggugccccgcugcccugucuguacuggcguugugaaacccgacauuguguucuuuggggagcagcugccugcaagguuccuacuccauauggcugacuucgcuuuggcagaucugcuacucauucuugggaccucccuggagguuuguugaaaggcauguggggauggguaggagggcgguguggagggcuagggccugguugacggugucaccuuuucaggugaggagagucacugguggugacacuuaggguuugaggacaauggcuguguaggagggcguaaggguguagugaaagguuagccauggggcagggcugaaaggacugaucucggcacagagcuguacuaugggaugaagagcacauggcggcccugaagugaccuuuggugggaggagguuggcugcagcaucagcaguuagcugguacggggcagucagaggaccaguaggguuggggucugcaugcagguaugucuguggcucuguauggagaugaccacugaucugcaucugagucagaaugccagcgaguuuccaaaagguguaaagaggcaagaccacgggcuggagcccaucuguguguagacauaggggcaaaagguccaaaaagcucuguucaggaggccagcugugcagaggcugaggucugugcacucagccugccacugucacugcgugaugugaacaggccggucuggugcuuuagaccacuaacgugagauucaaaacuaaggcaccauugugggugguguguacggaaggacgugucagaguaaaugaauauuguugcaugggcuguggaggggugacauugcaaugcagcuguuuagugugagccuugucagugggucucaauaaagugguaaggcuuucugcuuaagguucggugggguacccuacagugguagcagugaggccagggccauggagaucccacugggaggucugaugcucugacuuucugcugaaaaggcuccugugggcugugcuguggauuggucagacaggacucagcaaagucccuugcugcugggguuggaugguccugacagguggcuagauaaaucagcaggggccaugacuguggguguaaagucagaggguacuaugucacguaggacauggaagagagugagcuaccacagaacuagggugugugugcccuguuccuaucauguggguuugaggauaccagcucagccaaauaccuuacaaagguaucugguagccaagguauaauacccuaaaggauaagguagcaaaaugugggugugggaaguagagucaggagggaccugggugaaaggugagcaaguagaagauuccagagugcugucauagauacagguuuggaaggaaggacagacuuggguggggguagaggggcagucaggggccaaaggguugggcccucuggucugugguacucaguauaugggcccaguucuucugauuauggcagcuaucagauaaggacacugagacugucagucaccuuuauuuuugaaguaaaaugaaaauagccauuuuuccuuacuuauaaauguaccaucugauuuuguuuguuuugagacagggucuuucuacauagcccgucuauucuggaacucacuauguagaccaggauggccuugaacucacagagaucuccccacccccgccucugcauucagaguucugggauuaaagguguauaccaccacugccugccaaccauaugcuucuacucauuuaugccagguaguggugacugccaccagcacuuuagaggcagaggaaggacagccaggacuauacaaagaaaaccugucucaaaaaaucaaccaaccaaccaaccaaccaaccaaaugucucguuuacagcagcagagacaaaguggagaaucaacuuuauucugucaguuuuuauuaucuuagucuauguauguggguguuaugucugcauguauuuuuggugccaguggaguccagaagagggcaucugauucccaggaacuggacugagagguaguugugagcugccauguaggugcugggauucaaacccaguuucucugcaagagcagcguacccuaucucuccagagccuuuaaagaaucagcuuuaaagaacaguagcuacuaauauuuuggccuacauccucauuggugucuuuucuuggggacaaauggcagaggccacacacugugacaugggugaugugagcacccaccuggagcagccuugcuagugcccugcuagugcuguguccugugagugugagggcacagacaggccaggccucaauccacuaccagugugggguaacaaaucugcaguguccuggauccuauauuugcagaaaaaauaguaaccuguuagauuagauuguggagcacuuaaucauauaaucuucuucuucuccuucuucuccuccuccuucuucuccuucuucuuccucuucuucuucuucuccuuccuccuccucuuccuccuccuccuucuucuuccuucuucuucuuccuucuucuuucuucuccuccugcuccugcuccuccuccugcuccuccuccuccuccugcuccuccuccuccugcuccucuucuuccugcuccuccuccuccuucuucuuccuuccuccuuccuucuucuccuccuucuuccuccuccuccuccuucuucuuuucuuuucuuuuuuuuuuuuuuucuuuuuucgagacaggguuucucuguauagcccuggcuguccuggaacuuaaaucugaacuagccagaacucugcaacauuuccagucauagguucuaagucaagaauuguggaccuauaagacaauguauguaggccguugcuuauugguggacaguagacaaacaguaauuugugugcugucugccguggugacuguccauguguguauuuacaccuaugcagguccucuugcuggacaaaugcugauaucgguguaugaggguccaguugcuuacauugucaccaauaugaaaaugacccauuuaguuuucugucauucugaacaguuacagagaggcaugacagggcuggugauguggcuugguggguugcuugccuagcaagcacuaagccugggucagcucccgccacagacccuguggggccuuauauuccugcucauguuuauguaccguuuguuuccucugcagaguugaaucacucgcccguuucucucagggcuguaauuagcaacguaauuaauguguauaaagcaucgcaccauacuuucccacagcaguuuuauguagaugucaggguggcagugccgaagucaccucucuccucucacuucagguucacgucuagaacaccuuuuccuccucacacccacaagcccuaguuuuucuuuauuuuuaagaacuuuucuuuuacauuuguuuauaugucugugugggccagaggacagucugugagagucaguucucuccuuccauucugguuccuagggaucaaacuuggguugucagguuugguggcgccuuacccacugcgcuaucggcaccuucucuaauguuuaggagcuguuaagacucuuugacuuguuuugcuuuucauuuuaaaagauauauguaugagugauugccugcguauguguaugauguaugugaguguguacacccuguguaucugguaccuaugcacaggauauugaagacucuggaacuggaguugcaguugugaacugccaugugguugcugggagccaaacccagcagcaagcacuccuagcugcugagacauuuuuccagccccuuauuuugauuuugaggugagggucuuaugugcccuagaugaccuucaauuugcuguguagcugagaaugaccuugaacaucugacccucggucugucucugacugcugggauuagagcugugcuacuaucauccuggcuccacagcugcuuuguucacacuuaaaucuaaaaucccuuucaaaguuccacagugaaagguaagaacugacuuuucccuuugagauaggagccaggcuugaucucaccccuuaaugaacucauuuuccaccguuauucuuggugcagaaauaggacacugauggggacccaggaagugggacaguagcagggugauaaaggguacuugcuccucuuugucaggcaaguauaggggaggcucagagcagggccccggcuguagaguggacagagcagguagaaggacaaugcuugcgggcagaacaugcagacaggggaggaggauggaguguggggagaagucagagcuuguauuggcccacccagcagaagagaggggcuauggaugggaaagagaucacccgaccaggggguaaaagccuuuguaaacuaaguggcaggcucuuugugucagucuccugccccaaggugucagugacuaguguucaauguccugaugugcauggucacacugccucucacauuuggguuaucuuucagguggagccuuuugccagcuugucugaagcaguacagaaaucagugccccgacugcucaucaaucgagacuugguggggccguucguucugaguccucgaaggaaagaugugguccagcuaggggauguaguucaugguguggaaaggcugguggaccuccugggguggacacaagaacugcuggaucuuaugcagcgggaacguggcaagguacaguggcucuggccgguccgacagagugcauccucucuggucacugcccucagugcguggcuggcguuuaggagcguggugccccuacagaccauugcuuuugcuuccuacucuacagcucucugcugggacaugguucugggaccuaggggaggggaagggcugagaagcugacauucucugcucccugcaugggacagagcuaaccugaaaugguuuguuaaucagugccauuaucuaguauagccggugggaauaggaagccugggaacacugcucuagguuuuauaguaccugugaaucacaggaaauaaucuccugugagaaccagguuauaugugauuauuauaaaaaggugcugcacugcccaggucucaccagaauauaucacagcugauguuauguggcucugggucuguggucucacuuuaacugucaaaagcucccagccucuugugcuuagccugagcccuuaaugaaacuggaccaaagagaagccuggcauauuaaggagccguggcauuuacugcuuccacagaugagauguaaccaccaguauugcaucuuuuuguuccaaggcuugguucuuaaggcugaauguacgcaggugccauuuauuagaaaacagucuauguuuugugcuaggccuucuggguucccuuuucuuauucauuucaaagacaaaaguuuguuccauaaaauauuuuuuaccucaaugacugauccaugucuaggaucugcuagccucugugugugauguuaacugaccucugccuguucuagcuggauggugcuggcucugugugugauguuaacugaccucugccuguucuagcuggauggugcuggcucugugugugauguuaacugaccucuugucuguucuagcuggauggacaggacagauaagacuauggcuucuucaccuggggaagucacacagcagaucauccuauguccagcaagacuucaugccugaagacagcuccaacacguuuacaaacaugaaccagaccacaacauguggccuggacagugguccuccgaggcugccuuuggaaaggcugaccagggaugucuacccuuggggccccuccaugugugcgcccuguccaccucaucacugcugaagguguagugcaggugcugcuuucugcagcggcccuuaaguuaucacgagggcagcacagcacgcccgucgccaggcaggcgaugcacuagggcaaucuagcauguugaucgguaaaguggcaucuuuaacuacaacaucauuucuugcaugaaauaaacuuaguauaaaaacuuggcau

SEQ ID NO: 12405 - RNA, 15182 nt, Mus musculus
agaggucuauaaagagugaggagcuaggcgcgcgcgcccgguccgagcgagcgcguccuugcuucaaagagauagugacucucgcgccuccggcuaggccuccagcccuucucuacccuacgucucauucuccgcaacgcaguucuccggcccgcaagcgcuccaggcuaucugccagucccggaccccgguacugcguccccauaccgcccgcuccaggaccaauccaagcuccgcaggccgcgcaccgccauggggguggagggcugcaccaaaugcaucaaauaccugcucuucgucuucaauuucgucuucugggugagcagccacuggggacagggcgcaccccacgguagccaggcugggcagcgcgcuaggcccugcugagaaggcgcagcgcaaccgcgaaguugcggcgccaccugugggcuccgugcgccgaucgggguccuggcgccccucgccagcggguugaggccgagggcugagcuucugggccucggcucgaggggcuucuggggccgggaaaucaggggaucgcuggccuguccccucugagugcugggaacuggugcaagagucugcgggcuagagccagguaaucaagagcccucagcuaugaaggggguacucgcacccuccugaauguuguuuuggggaccauccugcaucgcgagcagugaggggggucgagaagggcgggaucuuggcgccccgcccccaugagcucauccuagccaccgccccuggauaggcggccucgaaguggugggggcacgcuccguacuugccucggagaccucaaccccacuauuacuccacccuugcuuacccuccagcuugguauugccacccugggggcucgagcuccaggccuagaaggcagggcagcccgggccgcgugcugcugcgcacggugccccaguucuuggccacccccacccccauucccccagcugccccuccuccuugccugucgucuccugcacagauuacagccccggccugacccuuagauccugagaggaagaggguaugcaguucugaguuggugaaggccaggguguugcaaagaucugggaucuguacaaaccaggagcuuaggaucuuuuccuauauacaggaucuaagcugggcucuccacuuuggaaagaagugcacacccauuuggucaucuuggaaaggagacauggguauaagagggucuccaagugucccuggguccugacugucuucacugcuggggaguagccauuggugguaugggcuucuuuccauuuccuaacuggguugggaauggggagucuuaacagaccugccugcgggcacuugagugagcagugcuggccacuccucuggacaguggugccacccucccugcugcagugcacagacugcuguucccaccacccuccuucccaggaagaaaugagguuaugccaagacaauguuucucuaaaguuguuccugagagggcaaacuuguacaacggccccuggagugaguguguuggacaggggacaccuguuuuccaucgaggacugcugaagaucccagggcgggucagggugggguggaggggaauaagacguuggggaugggcaggaacugggcugaacucagcuggggcuauguaugcucacgcggugcugcagggaccaagauugucagucacggugacuccagagaacacauucuagggagcagcaugggcgaugggguuaaacuugcucugcccgggcaugccuuggggucucgacuggguagucauguuggacagugcuugccuacucugaaccaugcaaggaauugaaugcacccucaagaaguguguuauccaccccaccccacccccauuauucuucagaugugggaugucaggauccuguaggguauuucuuucuuucuuuuuuuucuuuuuuugcucacccaccugauccaagcgcuagacccucagacucccuggagugcugaggcugggugaagcugcucguuucccaggcagcugggguggagucccaacaugucccuggggucucuauugaggcuccaggaaacgguucugaagccucucccugcucccagggaccugccuacugacugcagaacagugaaaacuguagccuuucacaaucccacagaccucuccucccuacucauguuggccccacaguggauagggauguggagcagaaccaggcuacaacugguggacaccacccuggcagagggacuccuuuugucccucguguggcaagguuuguacuguggcugauaguucccugauaucaugaaauugaaccuuuggggagccccaccccaccacucuggcccuuagucuucacuuccucccucuaaagugggaguucuugggggucucugucuccuaggauuguguguagacuagcuaauguacuccagaguggggcaaggggcuuggagcagagaaggcucaggaaauggacacuggacacagucuccaaaagggaguggggccaaaggaagcugagcaaugaugucagaagggccuaaggagggggcugagagguccuuugggccguggugggggcgggggcuaagagcucuaagaagggagauuugguugacaguaaauguuucgauggacacuuuuuaaaauuuccaguuugaagauuaaagugguuucucugugggaggggacauuccgggcacacuaaccugccugcugucacucccaccaguccuccuugggcuugaguucagaaccuauauuggggccagcagaguucuggacucccaagauauauggggcaggacacaaaccugaaagaugagcggugagcagcagagaccauguaagaugcucuuagaagcagggugguuacucauccccugagacaggucugggauuaaggguccagucuccucuggcaauagucaccggcuggcaauagggcaggagagcaggggaugguuuaucacugugccagccuauggccucgggugggucuguaggagcuuugugugacaaugucuccauaggaguagucaguuaaggagaagaaucuucacuguguuccccgacagaacaggcuguuccuccagccuaaggcugcugguggcccccguccaguagcccaggcagccagacccaccacaaaaggcugauuacagccucucaacuggcauuuaauucuccagacugaacaugacugucuguugugcucgcuucagcaacacacauacgugacugucugucacauaguggucugcuggcugccuuccggcagaggggcucuaauucugugggcucaggguggaaugagcacuuccugugacuugccccuugcuccuggggcugucugcuccgcccggcuuugggaaagacaaucauuggccugcaaaggggaagucugugguucaucccugggcuggcuucaaaaaaaggacauccgaacagugggggcacagagcuggaguagaccuggcagccucuacucuggugcccacacacugcgaccucauaauaagagcccccacccccauucuuuccgaacccuuuaggcauucucucggcacuugccuucuagcucaguccuaccucaaacggagcuucugugaugcucuaggagggaaccaacaacugccaaccuugauuccagaacccagaguccugccaaggggauuggaaccucaguuauuaaaccucuagccuuagaguccagcugcccuagggagagagcaaucauccuuguacacaagagagggcguaggguggggcagaguuauggagaagucaagguaccuguggcucuggcccugaugccagggaaccagguaggacacggugugaguguugggugacucugagugugaguguugggugacucugagacccuauagguagggccauuuuguuccuaggacuguugcuagagaaccagguguccugagaacuggccuucaguagccuucaacuguucaguacucugaccuggcaugccagugacuugacugugaccccuaguaccucccucacaaacacaaacacacacacacacacacacacacacacacacacacacacacagagagagagagagagagagagagagagagaucacuucuagauccagucuaagcuacucucccuggcuagcugcagggcauaggcuaugccauucaaaacuauuuggggucuucugagugggcucaaccuuugagggaacuguucacaagggguuggccagugagcagcuagcugguggugggcauccuggaauggcuaccaaaguaacugcaaggggauguugggagagggcaccugccuuccuucauaugaagucuggagugugugugggggggagugcauuagaaccagggcacccauaguuuuauagccccauagcacugaguugguaaccgaagccaagagccugguugccaggcagcuugggcagaagcugcugaguaacagggcccccgaguguccuguguuuccuugcacuaucucucggaucacuccauacaugaugucagcuugggucuucagaacuuucucagggugggucuguggcauccuaugacucauuuagcugugcuuuuacccauggucaagcaucaauguuggcucuguacugcagcuaaacagugagggguuccaaugguguuuaaagaugucccgugugacggggagcaguaaugaggaagcccaggccaccuguccuccugaagcccaucccugagcucuagaguaggaccuuguguugcaagggcuuguggagugugacaaacacauacuguggaguguggcaggcacauacuguggagugacaggcacauauugucacugccaccaacccacuaguguuaacucaccuucucacaacuuuuuuuguuuguuugucuguuuucaaggcagagcuuuucuagccauccuugaacucacucuguaaaccaggcugggcucaaacucagagauccgccucccucugccucccaagggcugagauuaaaggccugugccaccauugccuggacucucauuacuuuucauggcuaaaaauccucaugguuggggcaugacauggccuuugacccuggaaacagucuucuccuguacucuggaguccgugauaacagcucauucagcucaccgaaaguaacacuccguugggcuguuaucagacccguugcgggugauaaggggacugagguuuccaagcaacuagcuaccacguucggaaguaguaggaucggguagaacuacacuccacucugccaccauguuccauagucaaaguggccuguaagacccugccagccccacagccugaccuugggacagagggcuaugcccagccuggaacagauagaaguccuuuggugcugcugguggugaugccagaacuacauagagcucuucuacccacucucaguccccugccucccuuuguuccuuuuucuggguaccaggacucccugcagcacuuaucucuggcagacugcuguggcgggcuggguccacacagucucccuauggggucucacgagacauuggccuuccuagaggagggcaagugcgggauagauggggaagguccuugccuucuaguuuccuugccugagaaggagccauguagucuggcccuggaaggggcccagcuggguggcccagcccaaucucuugaaccucaagacagcaguauauucucccauggccaugccugggccauucacaccacugccccuagccugucaguugggccccagagcuaggcauuugcuuugcugccuauuuuuagaugcuaugacaguggcuuccugagacgaggggccuugugaaaggaaccaugcuuccugcccaaggcgaggauuccugccccucucuccagcuuccuuccugagcuuccuuugguagacuguaagucuuuaccucuccuaggaaggccugagcaagauccauugucucucagagaggaaucuggccuuguccccauccucuauaccccagaccaggcccaggaccccagcuagaaggacagcaccuaagucagccucuaccuaaccaaugccccuaaaaccagucugagccucuuuacucugacuuaucccagcugcccagggucuucacaaccucugccaucacaggagagguucuugggccccucagcaccuccgaauugcuuaggugggugagcacuuuguggugcaccuucuagcuugcaucauguacucaggaggcuuugaguaagccccaacccugucugccucugccuuugguucuucucuugcggcccaaaugguaacucaaaggaacaagcugcuguuacagccagccuccaggagcauuuuggggugcuuuguggugaccauucauaccuaccaagcugguuucaggagcccugucccuuccuagagaacuucauauggguagcaauaggaaugcuucagagaagccccuaucugagucuggccaaggcugggcagugggcagcuagcacaggguagaaugcugucccaagccuguacccuuucagucgcuucugggaaaccacaagagcagcugggcagggacccagcaugcuuggcagcuccucgacuuguuaaaguuugagucuguuauggauuagcccuuaagaaggaggaagcaacacaauccuguauagagucaugaaugcauccuuuugugccagggaaggagcuccaggaaccuggacaugccaccugggugcgucccacccccaccucuaaacagaaggucuuuuaggcugcaggagcagguggcagggccaccuggagaaaggaagcuuugggcagagguaucuuagagccccugaguggauucgggaagaaaugccagguucugcuuuguggaucacuuccucagcucugucaagagcuaaauacagugacaucacacuuagcagccuuuguguauuacuuccccuguuuacaaaugaccauaaggguggaggagauagagauggauuugugacacccuagcuccgauaugacacagauagagauucaggccaucuuuacccuuuccuggaccuccaucuaauggcacuacuccauauucccauggacauuggacucacacacucucccucccuccuucuuucuuucuuucuuucuuucuuucuuucuuucuuucuuucuuucuuucuauuucuuuuuuuucguuuauuuuuuaaaugaguguugcccagauuuugcagaucauucugaccuaugguucuguaaacaagguguauuccuaauugcugcuaauacugggacaccccuauacccuucuugggccuggggaauauacuugagcagagccacugauccagggaccguggaguggagggggguaaguagcuuucuguagcugugcuuggcauuuacacccccaugaaacuuagcaccaucaggagaguacccugggcucuuuguggucuaaccccagaacuuccauuggguuaucacuguacuaucuugaacgaccuuugaauucugcuuucaucugagcagggucagaaggcgcuagcugcuucagcuucuguguccuccuuuugcuccccaugauugaacuguccuccgugcucucucacgggucugucuuuucccuggagauucuaccauucgauggacccagggccugugcauucacugacuggaacuagaacuccagaacucccucuaccucucccuagaguagcaggguagacggucacuuugcuggaggaagccaucucaguaccuggcauuccuucccacucagcucugauugccccugggacaauggggugaguggccaaguccccauuuccagaugccuugccuacccccaccccaguuuggccucucuucugauugacagucacagauccuuagccccccccccccgugcaccccccauucaggacugucaguuaaugaauaaagcccagagacuuuucuagaguuaacguccucaucccaccucuuucauaaaacccggcucuaagugguggcuuggccagacacccacauuagcagccuuuggggcucggcugaacagcaugccucacuccccuuugccccucagcucacagacaguauucccguaccauuagagaagccagagucaggcaugguugcaugcucagcuguuuuacagguaagcacacagacugaggaaagcaaggugacccaccagcugccccuuagccucugugacuaucagggauugucaccagggucauguuaucaaugagggaaggauggggaacaggugugccaccugguucuccugcccugggacaucucagagcagccuccagaccagaucuuaaacaaaauauaggauguuuaaaagcugcaaaggaagccugguuaccagggcaacucagacccgucaccucccacccuccugcuucuguugcccaagcugauucgagcgagguucuuaagggcagauggauaaagagcugucaguguaacaugcuggaaauucuggggaucccuggcaucgcuagggccguuacaugugaaggcacugucagagucucagccuucaugccauuugugguuugggcaacgggugcccgggugugacuuugauugcuguaucacacacccucuucucucaggcccugguggagguugggggcucaucccuccuggauuggagugugaaaaacgaaauuaagcacuuaaagaggagucugagaaacugagaaagaagggguggagggagagggagauggugaucaggaaaguaccccuccccagcuuccucucugaggguuaagcagcggacaugauccuaggguagaagaaggcagauggguccauaggucuucuuuccugaaccagccugcuugcaaauuucucccagagcuuucuugagcuuguguucuggccuggauccccagagugaagagcagauacuuuuuuuuagacccagguuuugguuucuauuugcuguuucugcuggggagugccacugacccuucaagaagaggagaccuggcgcuggggaggagacugccuuccuuggucuguucugaggcccagcuucugcucccagguaccugcuucucucugcggggccugguggcaucacauggucaccccugaggacuuggugucuccaccacagaguucccaguauccugccugaagcagucucuaaucaaucccaggacuguugggacaggguaccugaggagagcccaccagcauccugaguggcugggccucacuguggccauuucuacgguaaaaauguugcauaguuggucaaucuggaacaguaggggggggggauguuuccugcugauuuuggagacaagguuucauauagcccaggcuagucucaaacucacaugaccuugaauuccugauccuccugccucuaccucucaagugcugggaugacaaacaauugccaccaaacccuacgugguacuggggauugaacccagggcucccuacaugcccaaguacucuuaucaacugagccauauuuuucagaccaaacuucuuguaugugucuugcgcuauuggagguacacuugaauucuguucuggaguuacaaccaagaggagcuggugggacccagggcucaguggcaguggcucagacaacugcuuggcaucuggcuccacaacuggaagugagggcucuacaugauaagcauuguaggcuuccauuggccccaguacucuggccucuauaugacacuguuccugguuuucauuucuuucuuucuuuuuuuuuuuuuuuucuagcuggcuggaggcgugauccuagguguagcucugugguugcgucaugauccacagaccaccagccugcuguaccuggaacugggaaacaaaccggcacccaacaccuucuacgugggugaguaccaaggagacggguuccagucacagugcagaacagucagggagggcuuccaagaagaggcugaugguccaaaucuggugggugaggcguuagagcugggaguggccuaggccuaguaugagcuggguagggaggcugccuauaagaggagaaugaguuggcuguggugcugcuggugaccccacagaucugagacuagacuaggcagaaaggaagcaacgggguggggcaggggccuuguaggaccuugcuuauuuuaacaugggcauuucuagugaaccucccugggcaggguggggcaggaugccugggcuagcaacagcugaggcuccaggaguccugaguugggaagggcuggagacugggccgacagugaaugacucagacaccccaccccaccccacccccaccagcacacagcccagacuguuacaccugccuuauuuggcugccuguaggggcugaacacccucccuccuaaguaagaugauggcuguugugcugugugguccuaugcucugguccacuacacugugcugaaggagaaaacuuuccucuuuccucccuggaagagggaccugguguccugagaacugaagaaguauuuggagaugucuuuacccuuccaaagcuccuaccuucaucagggcucugauguggaucuuccuucuccuccuguggagccuagaagaggcuugggaggcaugcuugaggcugagugggggaccaggaggucugaaauauucucccuuucugcccaauugccucagagcagacagggcuuuugguuaccccauggcucgcucuguuuccuuccucccuauacucuguccacagccuuagcauggguaaaauggacagcaguggaguccaggcaauaugggcaggggcagaaccuggucuccuuugaggaaagccaugagggguagcaguuuucagguuugguuguuaguagggaagggcccacacuagcuaucccuccuucuaucugguaccuucagagaaggaggaugcccuccagcucauagaaacuggauuguggcaacugguaggcaucuucacaagggaaaucugggaaucagagacagacagggguagaacuggccggugggcccuccacaaggggaaggcugugcucccacucugcacagguauggcaggagaggcuggcuacccugcagagcccagauagggugguuaggaagcaagucucuauccuaauguucucauaauagucuauaccaggcuccaguuccagagcggcucagccaccugccugucugguuauggccuccuggguacuggggaaauagucuuagggacuggacccuguagcagguucuucuaccuauggguagaagcuacucuggcugccaugucccuggccaaucugaauuggcuuucuggagccccaugcugccccuguacugagucccucuaggagcagauguggcccugaaaaaggugucuuauuuagugcuuaggagaguucauucagagcuugcuaaacaucccagacaacaccacaggggcuucagaugagacaugugcuagacauaggagggugccuagggccuagaaaguccugggacagugccuguguguugggugcccuguauguauccuccuguugagacagagccuccuguugagacagagugagguugggguuuuagggccugacaacuggggugcucugccaguugggaggcaagggggaaaacaguuucuaggcagcccuggugggaggccuuccccggaccagacguguuuagugaggccaaaggauuuggccuauuuuuaagucuggcagcagguccaggccauggugccuucuccucuggucuggccaggcagggaacaaugggccugacuuugugcaaggaagcuuggacugcccuacaguguugccguggagacugggggauggacggcuucugccgagggaccaagagauggaacgcucaucaaagacacagugggcuuucccaggggcagaaggggguauugugggcacugaggcagggacauggcccaguugguaccucaugggcuacagugcuccccuguaaacugugacagacauugggugcucugcuuaagcuuccccuaccauucucuuagccauccacccacacacaggaucccguccuuagaguuaggugagccaaacaguuauacaccaguguuccugagaugaggugccuggaguugguuacugccauagcuuacccuugauuucacacucaccgaguauugggagucuugggcauuggcuccugacacccaagccacuuccccuaacugaaacggauaguccgucucagcccuuuacagugcgugcugaggguuccuguucucagaugcagguggugggagacuggcuccagagcagagcauaccugugaaauggagaccacccauguucucuggucacugaauugcugcuuuguccccugguggcaguggcagcuccuccagcagcacacggaggcauaaacggcgcacauugcuaaacucugccugcugugguugugaguuaggccuuccugugugauucaugcagccugcucacucaggucuucccuuccccaggcaucuacauucucauugcugugggagcugugaugauguuuguaggcuuccuggggugcuauggggccauccaggagucccagugucugcuggggacgguaaguagaaagggcugaagggcuggggagcaggguuccuagcaacuuauaugucuuccccaagguuuugguuuuccuaggggcuugauuuccauugaaucugaguaugaauauacauguuggaaaaggggguuucuguuuaaaaaagcauaaacuccagaagggugucucaccccuaaagccaaccuuagugcuccuggccacacuagcugcuggugaagcugaaucccagauuugccagaaucuggccagccugggagggaggcgcugccaguaucagaagcuggggaaaggcagcacacgucauagaauguaggauaaaggaggugaggaaacugagguuaggguuggggagugucuugcugcaugugccucagugaaggcuguggacacuuugucaacugcauuucuacaccagccacauccugcaaaguaggaugcaaggugaggcuaugagaacuugaacaucucagugcaggacuguaucaggcucuugucucucaauggcucuguguggcucaugcuuaaucaggacaugguugguggauauggccaacccccuuggcacauagcuguuggucaugugggcuaggccugggcuugcuggucaaggcucugaccucuucuuuccccuaguucuucaccugccuugugauccuguuugccugugagguggcugcaggcaucuggggcuucguaaacaaagaccagguaagccuagguucaccgagugggagauaugcccucugcccuccaacagauguggguugcucugagcccauaguuauagggugcuuuuugaauuucuuggaccugcugcuugggugggggcagggucuugggagcucaguggaagagguggcaucaggcugagcccaucgggaaguugagugcucuugggcguagccccgacacuguaugugacuaugauucucccccagaucgccaaggaugugaagcaguucuaugaccaggcccuucagcaagcugugauggaugaugaugccaacaaugccaaggcuguggugaagacuuuccaugagacgguauagcuaggcucaagcaggaggggaggcugugggguuccuagugugugagggcaugggucuccuuucuuuccaacacaacagggccuaggaaagggucuccucuaugauuuguggguccucagguaggaaucuaaugggccucauuuucccagggguuugaaggaacagggcuccugugcagggugacaaacagggcagaaggacaacucccaaguguauuuuggggugacggugugcugugugccugaucuuucccuugucuccugaagcuccaaagcugacaguguuguucuuggucccugcagcucaacuguuguggcuccaacgcacugaccacacugacuaccaccauacugaggaacagccugugucccucaggcggcaacauacucacccccuuacugcagguagcauggaguggggaugaggugguggugguggucgguagggugguguggccaaucaggaagaucagcacuuugagcaagaccucagaagucccauagaccaucucuauuacugggguaccggguccucacagcuugaguuaaccccugcaacaucccagaaaacuguucucuugaguggucccucauacccuggugacccuagggugcuagugagguaaaaaaacacuccccugugacaaaaggcugcaggcagcagguccgugugucuuaaauuuguuuugggguggaagauaagcugugauacauagguccugucacugaguagggugguggcugugacuuagccacugaugguuaaccacgcucuugccaucccugcagcaagauugucaucagaaaaucgaugagcucuucucugggaagcuguaccucauuggaauugcagccauugugguagcugucauuaugguaagcacagggucucuggugggugggugggauccuucccagggccuuaggugcugacuaugccccucccuccugcagaucuuugagaugauucugagcauggugcugugcuguggcauccggaacagcuccguguacugaggcccuuugcauugcaccagaggaucccuggagugaccagaggccaccuugggggacauggccuguguauauaauauuucuguaucacucugcuacacuuagucuuuuuacuuuugaguuuuuuguuuuguuuuguuuuguuuuuguuuuaguuuuuuuuuuuguccugaacuuuuccuguuaccuuuugggagcugacaucacacauggguggcauaugugggauguagggguggagcuggcccuggcuugcagggcccuguacgucugggaccccuggagaguucugccugcugagccaaaccuccucuacagcuacuugcccagaggcuuuguagccuagcuagagggccaugcccacccacucaacccacugugggucacauugcucacaucuuuuuaaucuuuguuccuuuccugccuccauuucaagagcuggguuuguaagcccucuuaugccuucaaugcacuuauucuuucuaacgugucaccuucaacuguaauuaaaucuugaaacagucauuuaauaaaggaggaaaaaaaucaggcaugcuaa

SEQ ID NO: 12406 - RNA, 15182 nt, Mus musculus
uuagcaugccugauuuuuuuccuccuuuauuaaaugacuguuucaagauuuaauuacaguugaaggugacacguuagaaagaauaagugcauugaaggcauaagagggcuuacaaacccagcucuugaaauggaggcaggaaaggaacaaagauuaaaaagaugugagcaaugugacccacaguggguugagugggugggcauggcccucuagcuaggcuacaaagccucugggcaaguagcuguagaggagguuuggcucagcaggcagaacucuccaggggucccagacguacagggcccugcaagccagggccagcuccaccccuacaucccacauaugccacccaugugugaugucagcucccaaaagguaacaggaaaaguucaggacaaaaaaaaaaacuaaaacaaaaacaaaacaaaacaaaacaaaaaacucaaaaguaaaaagacuaaguguagcagagugauacagaaauauuauauacacaggccaugucccccaagguggccucuggucacuccagggauccucuggugcaaugcaaagggccucaguacacggagcuguuccggaugccacagcacagcaccaugcucagaaucaucucaaagaucugcaggagggaggggcauagucagcaccuaaggcccugggaaggaucccacccacccaccagagacccugugcuuaccauaaugacagcuaccacaauggcugcaauuccaaugagguacagcuucccagagaagagcucaucgauuuucugaugacaaucuugcugcagggauggcaagagcgugguuaaccaucaguggcuaagucacagccaccacccuacucagugacaggaccuauguaucacagcuuaucuuccaccccaaaacaaauuuaagacacacggaccugcugccugcagccuuuugucacaggggaguguuuuuuuaccucacuagcacccuagggucaccaggguaugagggaccacucaagagaacaguuuucugggauguugcagggguuaacucaagcugugaggacccgguaccccaguaauagagauggucuaugggacuucugaggucuugcucaaagugcugaucuuccugauuggccacaccacccuaccgaccaccaccaccaccucauccccacuccaugcuaccugcaguaagggggugaguauguugccgccugagggacacaggcuguuccucaguauggugguagucaguguggucagugcguuggagccacaacaguugagcugcagggaccaagaacaacacugucagcuuuggagcuucaggagacaagggaaagaucaggcacacagcacaccgucaccccaaaauacacuugggaguuguccuucugcccuguuugucacccugcacaggagcccuguuccuucaaaccccugggaaaaugaggcccauuagauuccuaccugaggacccacaaaucauagaggagacccuuuccuaggcccuguuguguuggaaagaaaggagacccaugcccucacacacuaggaaccccacagccuccccuccugcuugagccuagcuauaccgucucauggaaagucuucaccacagccuuggcauuguuggcaucaucauccaucacagcuugcugaagggccuggucauagaacugcuucacauccuuggcgaucugggggagaaucauagucacauacagugucggggcuacgcccaagagcacucaacuucccgaugggcucagccugaugccaccucuuccacugagcucccaagacccugcccccacccaagcagcagguccaagaaauucaaaaagcacccuauaacuaugggcucagagcaacccacaucuguuggagggcagagggcauaucucccacucggugaaccuaggcuuaccuggucuuuguuuacgaagccccagaugccugcagccaccucacaggcaaacaggaucacaaggcaggugaagaacuaggggaaagaagaggucagagccuugaccagcaagcccaggccuagcccacaugaccaacagcuaugugccaaggggguuggccauauccaccaaccauguccugauuaagcaugagccacacagagccauugagagacaagagccugauacaguccugcacugagauguucaaguucucauagccucaccuugcauccuacuuugcaggauguggcugguguagaaaugcaguugacaaaguguccacagccuucacugaggcacaugcagcaagacacuccccaacccuaaccucaguuuccucaccuccuuuauccuacauucuaugacgugugcugccuuuccccagcuucugauacuggcagcgccucccucccaggcuggccagauucuggcaaaucugggauucagcuucaccagcagcuaguguggccaggagcacuaagguuggcuuuaggggugagacacccuucuggaguuuaugcuuuuuuaaacagaaacccccuuuuccaacauguauauucauacucagauucaauggaaaucaagccccuaggaaaaccaaaaccuuggggaagacauauaaguugcuaggaacccugcuccccagcccuucagcccuuucuacuuaccguccccagcagacacugggacuccuggauggccccauagcaccccaggaagccuacaaacaucaucacagcucccacagcaaugagaauguagaugccuggggaagggaagaccugagugagcaggcugcaugaaucacacaggaaggccuaacucacaaccacagcaggcagaguuuagcaaugugcgccguuuaugccuccgugugcugcuggaggagcugccacugccaccaggggacaaagcagcaauucagugaccagagaacauggguggucuccauuucacagguaugcucugcucuggagccagucucccaccaccugcaucugagaacaggaacccucagcacgcacuguaaagggcugagacggacuauccguuucaguuaggggaaguggcuugggugucaggagccaaugcccaagacucccaauacucggugagugugaaaucaaggguaagcuauggcaguaaccaacuccaggcaccucaucucaggaacacugguguauaacuguuuggcucaccuaacucuaaggacgggauccuguguguggguggauggcuaagagaaugguaggggaagcuuaagcagagcacccaaugucugucacaguuuacaggggagcacuguagcccaugagguaccaacugggccaugucccugccucagugcccacaauacccccuucugccccugggaaagcccacugugucuuugaugagcguuccaucucuuggucccucggcagaagccguccaucccccagucuccacggcaacacuguagggcaguccaagcuuccuugcacaaagucaggcccauuguucccugccuggccagaccagaggagaaggcaccauggccuggaccugcugccagacuuaaaaauaggccaaauccuuuggccucacuaaacacgucugguccggggaaggccucccaccagggcugccuagaaacuguuuucccccuugccucccaacuggcagagcaccccaguugucaggcccuaaaaccccaaccucacucugucucaacaggaggcucugucucaacaggaggauacauacagggcacccaacacacaggcacugucccaggacuuucuaggcccuaggcacccuccuaugucuagcacaugucucaucugaagccccugugguguugucugggauguuuagcaagcucugaaugaacucuccuaagcacuaaauaagacaccuuuuucagggccacaucugcuccuagagggacucaguacaggggcagcauggggcuccagaaagccaauucagauuggccagggacauggcagccagaguagcuucuacccauagguagaagaaccugcuacaggguccagucccuaagacuauuuccccaguacccaggaggccauaaccagacaggcagguggcugagccgcucuggaacuggagccugguauagacuauuaugagaacauuaggauagagacuugcuuccuaaccacccuaucugggcucugcaggguagccagccucuccugccauaccugugcagagugggagcacagccuuccccuuguggagggcccaccggccaguucuaccccugucugucucugauucccagauuucccuugugaagaugccuaccaguugccacaauccaguuucuaugagcuggagggcauccuccuucucugaagguaccagauagaaggagggauagcuagugugggcccuucccuacuaacaaccaaaccugaaaacugcuaccccucauggcuuuccucaaaggagaccagguucugccccugcccauauugccuggacuccacugcuguccauuuuacccaugcuaaggcuguggacagaguauagggaggaaggaaacagagcgagccaugggguaaccaaaagcccugucugcucugaggcaauugggcagaaagggagaauauuucagaccuccuggucccccacucagccucaagcaugccucccaagccucuucuaggcuccacaggaggagaaggaagauccacaucagagcccugaugaagguaggagcuuuggaaggguaaagacaucuccaaauacuucuucaguucucaggacaccaggucccucuuccagggaggaaagaggaaaguuuucuccuucagcacaguguaguggaccagagcauaggaccacacagcacaacagccaucaucuuacuuaggagggaggguguucagccccuacaggcagccaaauaaggcagguguaacagucugggcugugugcugguggggguggggugggguggggugucugagucauucacugucggcccagucuccagcccuucccaacucaggacuccuggagccucagcuguugcuagcccaggcauccugccccacccugcccagggagguucacuagaaaugcccauguuaaaauaagcaagguccuacaaggccccugccccaccccguugcuuccuuucugccuagucuagucucagaucuguggggucaccagcagcaccacagccaacucauucuccucuuauaggcagccucccuacccagcucauacuaggccuaggccacucccagcucuaacgccucacccaccagauuuggaccaucagccucuucuuggaagcccucccugacuguucugcacugugacuggaacccgucuccuugguacucacccacguagaagguguugggugccgguuuguuucccaguuccagguacagcaggcugguggucuguggaucaugacgcaaccacagagcuacaccuaggaucacgccuccagccagcuagaaaaaaaaaaaaaaaagaaagaaagaaaugaaaaccaggaacagugucauauagaggccagaguacuggggccaauggaagccuacaaugcuuaucauguagagcccucacuuccaguuguggagccagaugccaagcaguugucugagccacugccacugagcccugggucccaccagcuccucuugguuguaacuccagaacagaauucaaguguaccuccaauagcgcaagacacauacaagaaguuuggucugaaaaauauggcucaguugauaagaguacuugggcauguagggagcccuggguucaauccccaguaccacguaggguuugguggcaauuguuugucaucccagcacuugagagguagaggcaggaggaucaggaauucaaggucaugugaguuugagacuagccugggcuauaugaaaccuugucuccaaaaucagcaggaaacauccccccccccuacuguuccagauugaccaacuaugcaacauuuuuaccguagaaauggccacagugaggcccagccacucaggaugcuggugggcucuccucagguacccugucccaacaguccugggauugauuagagacugcuucaggcaggauacugggaacucugugguggagacaccaaguccucaggggugaccaugugaugccaccaggccccgcagagagaagcagguaccugggagcagaagcugggccucagaacagaccaaggaaggcagucuccuccccagcgccaggucuccucuucuugaagggucaguggcacuccccagcagaaacagcaaauagaaaccaaaaccugggucuaaaaaaaaguaucugcucuucacucuggggauccaggccagaacacaagcucaagaaagcucugggagaaauuugcaagcaggcugguucaggaaagaagaccuauggacccaucugccuucuucuacccuaggaucauguccgcugcuuaacccucagagaggaagcuggggagggguacuuuccugaucaccaucucccucucccuccaccccuucuuucucaguuucucagacuccucuuuaagugcuuaauuucguuuuucacacuccaauccaggagggaugagcccccaaccuccaccagggccugagagaagagggugugugauacagcaaucaaagucacacccgggcacccguugcccaaaccacaaauggcaugaaggcugagacucugacagugccuucacauguaacggcccuagcgaugccagggauccccagaauuuccagcauguuacacugacagcucuuuauccaucugcccuuaagaaccucgcucgaaucagcuugggcaacagaagcaggagggugggaggugacgggucugaguugcccugguaaccaggcuuccuuugcagcuuuuaaacauccuauauuuuguuuaagaucuggucuggaggcugcucugagaugucccagggcaggagaaccagguggcacaccuguuccccauccuucccucauugauaacaugacccuggugacaaucccugauagucacagaggcuaaggggcagcuggugggucaccuugcuuuccucagucugugugcuuaccuguaaaacagcugagcaugcaaccaugccugacucuggcuucucuaaugguacgggaauacugucugugagcugaggggcaaaggggagugaggcaugcuguucagccgagccccaaaggcugcuaaugugggugucuggccaagccaccacuuagagccggguuuuaugaaagaggugggaugaggacguuaacucuagaaaagucucugggcuuuauucauuaacugacaguccugaauggggggugcacggggggggggggcuaaggaucugugacugucaaucagaagagaggccaaacugggguggggguaggcaaggcaucuggaaauggggacuuggccacucaccccauugucccaggggcaaucagagcugagugggaaggaaugccagguacugagauggcuuccuccagcaaagugaccgucuacccugcuacucuagggagagguagagggaguucuggaguucuaguuccagucagugaaugcacaggcccuggguccaucgaaugguagaaucuccagggaaaagacagacccgugagagagcacggaggacaguucaaucauggggagcaaaaggaggacacagaagcugaagcagcuagcgccuucugacccugcucagaugaaagcagaauucaaaggucguucaagauaguacagugauaacccaauggaaguucugggguuagaccacaaagagcccaggguacucuccugauggugcuaaguuucauggggguguaaaugccaagcacagcuacagaaagcuacuuaccccccuccacuccacggucccuggaucaguggcucugcucaaguauauuccccaggcccaagaaggguauaggggugucccaguauuagcagcaauuaggaauacaccuuguuuacagaaccauaggucagaaugaucugcaaaaucugggcaacacucauuuaaaaaauaaacgaaaaaaaagaaauagaaagaaagaaagaaagaaagaaagaaagaaagaaagaaagaaagaaagaaggagggagggagagugugugaguccaauguccaugggaauauggaguagugccauuagauggagguccaggaaaggguaaagauggccugaaucucuaucugugucauaucggagcuagggugucacaaauccaucucuaucuccuccacccuuauggucauuuguaaacaggggaaguaauacacaaaggcugcuaagugugaugucacuguauuuagcucuugacagagcugaggaagugauccacaaagcagaaccuggcauuucuucccgaauccacucaggggcucuaagauaccucugcccaaagcuuccuuucuccagguggcccugccaccugcuccugcagccuaaaagaccuucuguuuagaggugggggugggacgcacccagguggcauguccagguuccuggagcuccuucccuggcacaaaaggaugcauucaugacucuauacaggauuguguugcuuccuccuucuuaagggcuaauccauaacagacucaaacuuuaacaagucgaggagcugccaagcaugcugggucccugcccagcugcucuugugguuucccagaagcgacugaaaggguacaggcuugggacagcauucuacccugugcuagcugcccacugcccagccuuggccagacucagauaggggcuucucugaagcauuccuauugcuacccauaugaaguucucuaggaagggacagggcuccugaaaccagcuugguagguaugaauggucaccacaaagcaccccaaaaugcuccuggaggcuggcuguaacagcagcuuguuccuuugaguuaccauuugggccgcaagagaagaaccaaaggcagaggcagacaggguuggggcuuacucaaagccuccugaguacaugaugcaagcuagaaggugcaccacaaagugcucacccaccuaagcaauucggaggugcugaggggcccaagaaccucuccugugauggcagagguugugaagacccugggcagcugggauaagucagaguaaagaggcucagacugguuuuaggggcauugguuagguagaggcugacuuaggugcuguccuucuagcugggguccugggccuggucugggguauagaggauggggacaaggccagauuccucucugagagacaauggaucuugcucaggccuuccuaggagagguaaagacuuacagucuaccaaaggaagcucaggaaggaagcuggagagaggggcaggaauccucgccuugggcaggaagcaugguuccuuucacaaggccccucgucucaggaagccacugucauagcaucuaaaaauaggcagcaaagcaaaugccuagcucuggggcccaacugacaggcuaggggcaguggugugaauggcccaggcauggccaugggagaauauacugcugucuugagguucaagagauugggcugggccacccagcugggccccuuccagggccagacuacauggcuccuucucaggcaaggaaacuagaaggcaaggaccuuccccaucuaucccgcacuugcccuccucuaggaaggccaaugucucgugagaccccauagggagacuguguggacccagcccgccacagcagucugccagagauaagugcugcagggaguccugguacccagaaaaaggaacaaagggaggcaggggacugagaguggguagaagagcucuauguaguucuggcaucaccaccagcagcaccaaaggacuucuaucuguuccaggcugggcauagcccucugucccaaggucaggcuguggggcuggcagggucuuacaggccacuuugacuauggaacaugguggcagaguggaguguaguucuacccgauccuacuacuuccgaacgugguagcuaguugcuuggaaaccucaguccccuuaucacccgcaacgggucugauaacagcccaacggaguguuacuuucggugagcugaaugagcuguuaucacggacuccagaguacaggagaagacuguuuccagggucaaaggccaugucaugccccaaccaugaggauuuuuagccaugaaaaguaaugagaguccaggcaaugguggcacaggccuuuaaucucagcccuugggaggcagagggaggcggaucucugaguuugagcccagccugguuuacagagugaguucaaggauggcuagaaaagcucugccuugaaaacagacaaacaaacaaaaaaaguugugagaaggugaguuaacacuaguggguugguggcagugacaauaugugccugucacuccacaguaugugccugccacacuccacaguauguguuugucacacuccacaagcccuugcaacacaagguccuacucuagagcucagggaugggcuucaggaggacagguggccugggcuuccucauuacugcuccccgucacacgggacaucuuuaaacaccauuggaaccccucacuguuuagcugcaguacagagccaacauugaugcuugaccauggguaaaagcacagcuaaaugagucauaggaugccacagacccacccugagaaaguucugaagacccaagcugacaucauguauggagugauccgagagauagugcaaggaaacacaggacacucgggggcccuguuacucagcagcuucugcccaagcugccuggcaaccaggcucuuggcuucgguuaccaacucagugcuauggggcuauaaaacuaugggugcccugguucuaaugcacucccccccacacacacuccagacuucauaugaaggaaggcaggugcccucucccaacauccccuugcaguuacuuugguagccauuccaggaugcccaccaccagcuagcugcucacuggccaaccccuugugaacaguucccucaaagguugagcccacucagaagaccccaaauaguuuugaauggcauagccuaugcccugcagcuagccagggagaguagcuuagacuggaucuagaagugaucucucucucucucucucucucucucucucuguguguguguguguguguguguguguguguguguguguguguuuguguuugugagggagguacuaggggucacagucaagucacuggcaugccaggucagaguacugaacaguugaaggcuacugaaggccaguucucaggacaccugguucucuagcaacaguccuaggaacaaaauggcccuaccuauagggucucagagucacccaacacucacacucagagucacccaacacucacaccguguccuaccugguucccuggcaucagggccagagccacagguaccuugacuucuccauaacucugccccacccuacgcccucucuuguguacaaggaugauugcucucucccuagggcagcuggacucuaaggcuagagguuuaauaacugagguuccaauccccuuggcaggacucuggguucuggaaucaagguuggcaguuguugguucccuccuagagcaucacagaagcuccguuugagguaggacugagcuagaaggcaagugccgagagaaugccuaaaggguucggaaagaaugggggugggggcucuuauuaugaggucgcagugugugggcaccagaguagaggcugccaggucuacuccagcucugugcccccacuguucggauguccuuuuuuugaagccagcccagggaugaaccacagacuuccccuuugcaggccaaugauugucuuucccaaagccgggcggagcagacagccccaggagcaaggggcaagucacaggaagugcucauuccacccugagcccacagaauuagagccccucugccggaaggcagccagcagaccacuaugugacagacagucacguauguguguugcugaagcgagcacaacagacagucauguucagucuggagaauuaaaugccaguugagaggcuguaaucagccuuuuguggugggucuggcugccugggcuacuggacgggggccaccagcagccuuaggcuggaggaacagccuguucugucggggaacacagugaagauucuucuccuuaacugacuacuccuauggagacauugucacacaaagcuccuacagacccacccgaggccauaggcuggcacagugauaaaccauccccugcucuccugcccuauugccagccggugacuauugccagaggagacuggacccuuaaucccagaccugucucaggggaugaguaaccacccugcuucuaagagcaucuuacauggucucugcugcucaccgcucaucuuucagguuuguguccugccccauauaucuugggaguccagaacucugcuggccccaauauagguucugaacucaagcccaaggaggacuggugggagugacagcaggcagguuagugugcccggaauguccccucccacagagaaaccacuuuaaucuucaaacuggaaauuuuaaaaaguguccaucgaaacauuuacugucaaccaaaucucccuucuuagagcucuuagcccccgcccccaccacggcccaaaggaccucucagcccccuccuuaggcccuucugacaucauugcucagcuuccuuuggccccacucccuuuuggagacuguguccaguguccauuuccugagccuucucugcuccaagccccuugccccacucuggaguacauuagcuagucuacacacaauccuaggagacagagacccccaagaacucccacuuuagagggaggaagugaagacuaagggccagaguggugggguggggcuccccaaagguucaauuucaugauaucagggaacuaucagccacaguacaaaccuugccacacgagggacaaaaggagucccucugccagggugguguccaccaguuguagccugguucugcuccacaucccuauccacuguggggccaacaugaguagggaggagaggucugugggauugugaaaggcuacaguuuucacuguucugcagucaguaggcaggucccugggagcagggagaggcuucagaaccguuuccuggagccucaauagagaccccagggacauguugggacuccaccccagcugccugggaaacgagcagcuucacccagccucagcacuccagggagucugagggucuagcgcuuggaucaggugggugagcaaaaaaagaaaaaaaagaaagaaagaaauacccuacaggauccugacaucccacaucugaagaauaauggggguggggugggguggauaacacacuucuugagggugcauucaauuccuugcaugguucagaguaggcaagcacuguccaacaugacuacccagucgagaccccaaggcaugcccgggcagagcaaguuuaaccccaucgcccaugcugcucccuagaauguguucucuggagucaccgugacugacaaucuuggucccugcagcaccgcgugagcauacauagccccagcugaguucagcccaguuccugcccauccccaacgucuuauuccccuccaccccacccugacccgcccugggaucuucagcaguccucgauggaaaacagguguccccuguccaacacacucacuccaggggccguuguacaaguuugcccucucaggaacaacuuuagagaaacauugucuuggcauaaccucauuucuuccugggaaggaggguggugggaacagcagucugugcacugcagcagggaggguggcaccacuguccagaggaguggccagcacugcucacucaagugcccgcaggcaggucuguuaagacuccccauucccaacccaguuaggaaauggaaagaagcccauaccaccaauggcuacuccccagcagugaagacagucaggacccagggacacuuggagacccucuuauacccaugucuccuuuccaagaugaccaaaugggugugcacuucuuuccaaaguggagagcccagcuuagauccuguauauaggaaaagauccuaagcuccugguuuguacagaucccagaucuuugcaacacccuggccuucaccaacucagaacugcauacccucuuccucucaggaucuaagggucaggccggggcuguaaucugugcaggagacgacaggcaaggaggaggggcagcugggggaauggggguggggguggccaagaacuggggcaccgugcgcagcagcacgcggcccgggcugcccugccuucuaggccuggagcucgagcccccaggguggcaauaccaagcuggaggguaagcaaggguggaguaauagugggguugaggucuccgaggcaaguacggagcgugcccccaccacuucgaggccgccuauccaggggcgguggcuaggaugagcucaugggggcggggcgccaagaucccgcccuucucgaccccccucacugcucgcgaugcaggaugguccccaaaacaacauucaggagggugcgaguacccccuucauagcugagggcucuugauuaccuggcucuagcccgcagacucuugcaccaguucccagcacucagaggggacaggccagcgauccccugauuucccggccccagaagccccucgagccgaggcccagaagcucagcccucggccucaacccgcuggcgaggggcgccaggaccccgaucggcgcacggagcccacagguggcgccgcaacuucgcgguugcgcugcgccuucucagcagggccuagcgcgcugcccagccuggcuaccguggggugcgcccuguccccaguggcugcucacccagaagacgaaauugaagacgaagagcagguauuugaugcauuuggugcagcccuccacccccauggcggugcgcggccugcggagcuuggauugguccuggagcgggcgguauggggacgcaguaccgggguccgggacuggcagauagccuggagcgcuugcgggccggagaacugcguugcggagaaugagacguaggguagagaagggcuggaggccuagccggaggcgcgagagucacuaucucuuugaagcaaggacgcgcucgcucggaccgggcgcgcgcgccuagcuccucacucuuuauagaccucu

SEQ ID NO: 12407 - RNA, 1721 nt, Mus musculus
cgggcgcugaagccacgaaaaucugaucgcccgagacucgguuucccaggaacccgagcgagacuggacaggaccgaaucccggggaacuggcgggacgcugcgagaaaggcggcaggguauugaggcguguacggacgcuggaacggugagcacuggccucccuaaggccgcggccagggcauucccgugccuguuucugccagcccuucguccggacccggguggcgcuuguaccuagagaggcugcgcuuuacugagagcccgugaugggacaagcagcugauggagaucuccugucaccagcaucucccagugcucaucuauuguauguccacacuguuaugaucucaugguugacucucuccuuaaccccaccuaaccugcagcuccuguaucugugcgcgcuaggauacccuuuaaccacccagcuucgcgaggccucccguccggcugugaguagaggcacuugacacauaguggaggugaaagacgggagccugggaggacggggagggaugaggccuuaaauacaccccucacggcggaacugggacugcuucgcuacaggugggacgggugucaggucguauggcggagacagaggcuggccuggaggcugaugaacccaccgaggaugacacccugccuucugacaccgucucccucagcgacucggacucggaccuuagcuuaccuagugguguggagguccaaguguuguccccagagaggcuuucggaggagggccaggaggacuccggcccugaggacccuccaucgccccccacgggcacccucaccacugcagugcagccauuccaccuccgaggcaugaguucuaccuucucccagcgcagccacagcaucuuugauugucuggagagugcagcccggcaggcaccgugcucugcuccccaaaccagugugagugacaauggcagcuucaggcggcccgugacucccccaagucagacuccagcaaggggccugagcagagugcaugggaacacuggcccgacuaggguacucccagucccugacuaugugucacacccugagcguuggaccaaauacagucuggaggaugugucugaagccagugagcagagcaaucgugaugcugcccuggccuuccugagcucucgaagccaggugucccacacagacuaugugccuucuuucaaccaggaccccucuagcuguggggagggaagaguggucuucaccaaaccagugagggacagugaggcuagggcugagaggaagaggguccuaaagaaggggguugggucaggugcggggggugaggccgcuguggagcuagcccaucucgcuggaccugaggcugaggaauggaguggccaccagggacagccagagguggugguaccuucagaagcugcccauccugaguccucaucaggccccauaggugugaaggcuguugguuuccauggcagcaagaagcggagcagagaccacuuccggaacagggacgguaacccuggggggccggggucugagagaggacccucaguuugacugcagugcuaucacucuaccccucaccugcuaguccaagugggaaggugugggcugucugugguagggggaugugugcagccgcucuggcagagacugugggaauugugggucaggggaccucgaaggccuuugugccccaguguuuaggaugaauaauaaacguuuggaauauuu

SEQ ID NO: 12408 - RNA, 2658 nt, Mus musculus
ugauuuuuguugggccucuuuauuuagaaccuggcggacgaggagcccugggcaguugguaugggcaguacaggaaccauuucgacugucuggucaccaaguuuaagagcaaucuaaugaagugggggacacuguaagcuaacugaagaugaaugugugggggcuuuuacucaacaaccauuccccuagagucuaauauaaaaguagauuuacauuuguggguaaucugaagcuggugauuucuagugccuuugguaauaaucaauaacccagcaguugcguggcagagggauccacgcauggauaaauacaaauauuaaauuagcauaauuuuuuaacuuuuuguacaaauauacaugcuuuuuccuuuuucucaucuuuuuccuucguucuacauuuucuaguuucucuuuuuguuuugcacugagagcgaguagagauuaaacauuuuacauaaaugauuuaaagcuuuacaccuugggaccagcguacuccuugcacaugguacagaguguucucaauacauugcacaguuuucagauuuccacaaaaccgugggcugcucuacgcaaccaucuccgguuccugcuacaugaacgaaaggucccagccgaagcccagaguucuuccaucguccgcugcccagaugcccagcaaguucucucuggccguuagccucuaaacugugggaagagggacucaggugagcaggcauagcgggaaccccccgggggcggccccuccgcgacccccgugggggacgccagacucaccuaacucaucucagacguuugcgcggggucugcuccaccgcgcccaccccaggagccacguuuggagagggacacccuggagggacgucguucgacgccuuguucuccugcgcaguucucuugcgcuuggcgaagaagucugcgggcgacaacgcgcgucggucagggcggggccggcccagagacccgcgaggagacccgcggagugcgcagggcgcggggccggggugggggcgccauccccgcccgcgccgagguccgcggcgggucagcuuuguuuacgucgccgcgcaaugugcuguguaagcauuuccccuugucccgcggccaagccccccggggcugccgccgcacuuaacccccuccaugccgcacacacggcucccuaaggggcucccgcggcccgagccaaagaccgcgauccgagugggucgcggccaggcucgcccucccacugcacgcucgggagccuuagcugcaccccuaccaguaggaaaggggugcgggcgcaaccgcgcccuaagcgccgcgggcccuuuaaugccacgggaggaggcggggaccgggcgaggcccccgagggcgagggagagcccggccggccggacaaagcgaggccgggccggggcggggccgugcggggcucaccggagaugagaggccccgacagcuucuugaucgcaccguucgcauuggccgcagcagucccgggugcaggacguccuggaauccccgagagaggcugguccuucagcuccuggccgcgcugcucuugauucucguccugcuccucgaccggcuccccauucugcuccucgaccggcuccgcacccugcuccucgaccggcuccgcgcccugcuccuccuccggcuccucguccuucuccucgaccggcucugcgcccugcuccucgcccugcucagagaccggcucaguucccagcucaucacccggcucagcacccgacuccucgcccugcucagagaccugcucagggaccuguuccucgccgucccgagucgccacguccggguucgcguccgggaucggguccggagucgggucggaggucgcgaccagggucaccuccggaauugggucugaggucagaucugaagccggggccggggucgcggguggggugggcuccgcgaccacggccgaggcuggggcgcugggcggcugcucaggcgccuccucuaggccgucgggggccucgccagccggcggcccagaacgcgggaugacagccacggccaccggggguggccggggccccagcugcaggcgacagcgccccaccugcaccgucucgcgguagaaggcgggcacagacucgcuguccaccuccauccacugcagacgaccagggccucgaagaggcacauccugcuggaaguugaagucccagcgguucugguccucggcguucagcucggccaggcgcauccgcagcucgcggcccagcuccucguggucuacaggcccgaagaggcugcggcaggcgcugcuacgcgcuaucacugggaagguaucgcuggaggccaagcguuccaucgcuguucugcugcggagguacacgucggacaugcccauggucgaaggcugugcaaacgcgggcagcgagaaagaagggaacgggaggagaaggaagaggggagaggaggagggcggaggcugggcgugggugagaccccuugcacagcccgcguccgccucugccuaaggacgcagcggcuaccuggcugauuggugauggacggcuccugcgucuggaucgcuuguccuguccagcuugggccgcgcccccucggagcuugccugccuguucgcuugcucucagucgggccuagccggcaccccucgagcacagcgcacucggccu

SEQ ID NO: 12409 - RNA, 35513 nt, Mus musculus
cucaguuuguguuucacaacuuuaauagaauauccuaacuauucuguacaaauugaaaacaccguauucaguuacaaauguguuauuggguaaggcugagcacacucuacauggcuggucacuguggacauggcuguccuggcuaccagagacaccaccauacucucagaaacaccccuccccccacacacaccaaccaccaacuggucaccaaacccagguguggcccuggugugcacaguacaagcugaagcuguacuccacaggccagagaucccuagugaaggagaacuucuguccccuggcuacagccugccaacuuccagcggcaauaacauguagucugcauggcacagcacagcacagcacagcaguugguggcaggaagcagcagggcuuccuccaugagccucccuccacuuggugucacauccuccugaucaagucagcaacauggucucguaagugggaggacagugaaguccaaagcuccccaagcacaaguaaauaaauaaguacgagggugaacccgauggcucuggccucagaggugugugccacaacccacccaccccuaaaaccaaaacgcaagaaaaaaaaugcucuaaggcgagcacagcuuccucuacagugcuugggcgaugacuagggcacagcagcuggagcagcuucccacgcaguucagcagcuggaaaucauggggccuugccaguagggagggccgggugcacacaaucacaggcucugucaaucccaggcacaaccucgguccaccccaagugaucuucaggcaccaaagcugcaggugcuacaacuaaucuccuauucugaacugcagcagucuccacuguacaaguuuagcaaaguaagaagggaaaggggagaggaaucaugcacuuggaaaugguuagaugucacagcacugucaacaaaauucugcuuuggcagggacugaggccccugccugcggccugcgguccugacagccauccacaaggcggccccacagggucacugcuucucacugcugcuugcacuccgcuggcuggcuggguucuuucugcaagaauacagaauuugaagagaauaaaacaaguaucacucaucaagccuccccuucccauaagaaccaagacccaaugagcucauuccuucuuaccaaaaagauggcucccacaaauggacuuuaagagcugacccagaaauaggucagcuccccagagagucccaggugucugcuuuccuguucuaauaauguaaagucuaacuuagaaugugcuagcagacacuugcuggggccacuacaaggaacuagccacaugagagucuuugcugcagguauagaucacaccggcugugccagcaaccuccucucucuagggcagcccaguccugggcauucacgcagugaaggcaguccuuccgagccggcuggugcucucugcaauacccaaacagauucaacuccagugguucacagugcaggaguaaauggucagaggccaguuccuauagagcaugucuaucagucucacagagcaugaguccagaucacaccugucugaagaacaaggugacuucaaucuaaccuaacacacaaaccuggugucuuuaaaacacauccaagauuugggagcuuuguauguaggacaauaaaagccugaggacagacaaggaccuuacugcugccucagagcuaaaauauguacucaacucgccugauuuccagaaucccugggaacuacaacuucaaaucacagugguuccaggcugaggcagagcaaugcaugcucaaggccagucugacccacacagcaaggcucaugucuccaaguaacaaagacuagaaaugcagccuagcagcguagcacuugucggguaugcccgaggcccugggcuugguccucagcaccacaucaaaaaaucuauuauuuuuagagaaggacuguguaugaaccccuggcugaccuugaacucacaaagaucugcuugcauuggucucucaagugcuggggaaaaaaaauuacucuuuugcuuugagauagggucucacuuauguagucuuggcuguucuggaacuuuguaaaccagaguggccuugaacucacaggaaauugccuguuccugcaucuugaaugcuaagauaaaauguguguuuugccuacauguaugucuacacaccauguauguuccuagugccaucagcagucagaagaggagguggucagacugcuuggaacuaguuacagagagcugaauguaagcugccauguggaugccaagaacuucaacuuuggaagagcagcccgugcucuuaagcuaagccuaucucucuagcccugauaaaauacauuuauuaaaaagcuauucuguguggugugguggcacacaccuuuaaucccagcacucaggagguggaggcaguuggaucucugguguuugaguccagccucuauacaaagcaaguuccaggacagccagggcuguuuacacaaagaaacccugucucaaaaaaccaccaccaccaccacuaccaccaaaaaaaaaaaaaaaaaaaaagauugacuauggcuaugggaguuuguguguguucuaagaaaaaccugcaucacauguauguuaacaccagaaguaccuaugguaugagaccagaauccaccuugaagcaucacacuucaggggcaaaaauacaauguugaggcacacgagagaaucuuggcuugguuagaccucuacuuuuuccaauuuaaguuuauuuauguaugcugugucugugugaggauagguaucagauccccuguaacuggaauuacagaugguuguaagcuauuguguggauauugggaagugaacccaggaccucuagaacaacuagugcucuucaccacugagccaucucuccagccugagaagaacacagggauauaacuaagcccuccagguuaugguucccaccccuguguuucaggggccuuguaagucaacaaggaacccaagcccagagaugcugugcuauucucagcagucaacuucacuguauguggaauuaacucaaacccaagcuguugggcacuccugugggggacuuuuuugaugggauuauuugaaguggaaagaccuaccuuaaaccuaggccacagcuccuagugguaguuuauguaaaggacauggagaaagaaaguuucugcucuuuaccugcuugcccucacugucaggcaaguccauuccuucacuggcguuagagccuauuucuuugggauggugacauauacacaaaaccagcugagacacccaacuuuguggaccaaguaaggaucaaauguuugaacuuuccauugggagacagucaguucuagaauaguugaaucacagacuauaagccacucuaauaaaucccauuuauaauggauucauucuaucaguuguuucucuagagaagcucaauucagaugccaaucaagcaagagcugucaaaagacagccaaggcuagaucuagagguagucaacacaguggucauggucacuaaccuacugaccuagagagcaucagaggcagggugucccaagcgaguacagcagggauaggagagaagaaggcaagcaaugcacacaagggaaggagugggagcucuaggggcugggaugcaacgggggucucccccagcacagaaaaauaaaggcauugcagguaaaaaacaagugggcaaggauuaggugccucccuaccacggccucagaacauaggcauccugaacuuuauccuguuacuuaaaggaagugguauuuugaccacaggaauguaaaauuuuuugucuucaaaaaaaaccaaaacucgaggauguaaaaauccaaaacauaagccauagcaguuuagguaaugaagcuaccgaggagaauaaucuuuauuaggguggcagaagaggccauuggaaagguaagaacagugaggcagcagguuuacacaaggaaaccacagcuccacaccccacccaugccaggcaguaggcagcaguguccacuuaugcuacuacugggauaacaagcccuugaaggggauuuugcaaacgggacacuggcuuuggccugugacacagucagaaacuaaauugccaacugaacuguagcuucugcuacaucacaaaucuuaaugacaaauuggccggccccucaacauuagcacuuaaaaugcauuaagucggucaaaaccucgaucaccacaggccuacaugaggugggguuaucaaaagcauggugggccugagaaagguggagcugaggucacuuauauacuccacuaugucagcugcacuagagggcaaggcccacaccaaagcuaccagcaaguggacaugcaccauaguucugcuacuauggccucgauaaagaggaauguuuuaacacugacagucaacuguaccuaacagcuagagugaagaaggcccagagugagcccaucaaagacaacaggacuaggcucugucagacuccugucacucuggacaauuccuuauaaacuguugccuacaaauaaaaaaaggcaggagccuacacaugagauccuuguggugccucccacucugccuggccuuucuuccuuuucuuacugcauuagauaugugcaaaagcugugagcaccccacagggaagacucugucacugacaagggccuccccucgcugcuaauuacuuauaggugagugugaucuccaaacuaaacagggaaaacaaggugcccuacauuguguccacaacuggcucugucauccuccaaacaaaucuugagauggggcuuuauaguggccaugcuggcagguacaccaggccaccugacaugaucguuuuguucacuuacuggucuacccaaugccugguagacaccuagacaaauccagagcgacuacagucacauagugucuuuaagccuggugcaguguagacaacaggcauuuuucuaucagggcuuuuuguccagggugaccccugaggcucuuguucuguuaccagugacaaugcuccccacagcacagcucauugcgcaguuaucaaaaacaccaggcccugaagguaggagcugagucucacuguucugcugguuuuacaaaugcauuaacuguggagccaguacaagugccacucacaaggcccagaggcagccccagcuccuauacgaugcaauggaucacaucuuucaaugucccagaagucaaaauaaucaacgaaucaauuacagacagcaauuuggaaguuagguaugaacagauuccaccuuaccuagaaacgcaugaaugauuaacacaaaaauuacaccuaaauggggaaaaaaauugaaaaggaacugucagcaugaaagaaaaugaaaugcacaaaauuauacaggaggcaacagccacauucucaagauacaagagcuuccaguagggguaggagcagcuucagcgcaccagagcugcaugccuucccgaggucaaacuuuauucccucuuacaauaaacaacucccagacaacacugugugcaguuuuuuagugaugauucuaguuaccuuccacuuuggagggugcacaugaagccacagaacaaucacaccuugaccuaaggacagaaggaccaccccuuggguugccugcaacaacagcucuacacuguacccccauugccuacuucugaagcuucuuuccaccccuagacaaugcaaaaggucaaguguuugugggguuuucuacuaaucucaugauaaguugggugagaggcucucuucaaaaacggggauaugagaggagacagaaggcaaagggaaaacaacaggaagaagaaauaaaugggagaggggaugcaauggaggcuaugugagacaagcacagcacagaagccaaggugcaccaaguuggaacaugcaugugacaagcugcccuggucccugccaacuguacugugaccauguguccauccucugcucacagagcaugaauagccaacaccccgaggcucaccagguaguauagucuccaugacccaugagugaccuuuagaggggaguggcauucgugugggugguggcagcuuucccauuuuucccucuggaaacuucccagugugugcaugcauucucagcagcacagcagucacaccaccaagucgcugcacugacagcuuuuagcacacacuccacccagggaaaacaaggacaacagacagacacuagccagucagagaugcaaggcacagggacaccaggcagggaugcauuccaacagacuccacacugucaaacacaggaaaguauggcugcacuagagcagcucagggcauccugccaucgggugccaaagcccccuaaugaagagucuccugagaccacagagaaaaccccaagcuuccaggugaaacugguggugcagauugucguuucuuuugccagucuuccuguccugcaacaaucacuaugcauauguauauguacauacgaugcuuuuuugucaaucuccuaagcaaaaauucugauuacaagcuaauuuucuuuacuaucgcacacaauccauaccaggugcucugcugaugcacacgggugcuuccugucacaacaucccucuagggaagagcuggaagcaaugcauguucaagucuacagagaacuaguaacaccugguuggaucugacgccuaauguuccaggcauaugaguugccuuuccucaacuguggauuuucugacauguauauucuuagcaucauugccucaaagugggaacagcuucaaaagucccaccgugcaauacugguaggcucaggacguccccaaauuacuaaccuugggguuaacaucagcaucauccucaucuucuccuucuucaucaccuuccaauuccuguauuagagagacaaaaaaaugaugacuagggugugaccaaagagcaucaccugaaccuguacaaaguaacacacagcuuacucugcacaacacuugcuaauucuuacaaaagaagccagguagggaugcacucuaacagacuccacacugucaaacacaggaaaguauggcugcacuagagcagacacucaaugcuuaagagcacagacagcucuugcagagacaaugaauucaguuccuagcaucuaugucaggcagcucacagacacugcaaacuuuuguuucaggagaucuaucugaugccuucugcacuccacaggaaccagcacauaugcaugcauaccaggacagacaugcauaaucuuaaaaaacaaauuauuucuuuaaaaagaaaaaaaaaguaguugaauaggcugaucuagaagcucagcuuccuguggugucuccuucccacaggcaaaucacagcagaguucugcauuagggccacaggcacuaacaauuacucuauaucuuuuuguuuucacagauaauucugaaacauuucuaaaaaaaaaaaaaaaaaaauucagacauuccuuauuaaauggcuacuaauaugcauuuaaaaaaaauuauuuauuuaacaugccuacacugucacugucuucagacacacagcagaagaagacaucagaucccauuauagaugguugagucaccuugugguugcugggaauugcacucaggaccucuggaagagcagccagugcucuuaacugcuaaaccaucucuccagcucuaauauacaucuuuauacacaauuacaggaucaaaaucuaugggcaccaaaaccaaaugguuucaaaaucgccacugaaaccaagcaagauccuuggacuuccuaacuucaagcagacaagggaaaaccacacaaggcuggaguaacaacacaacacugcaugacucccuuccuuaccuccucuucaccuuccucgccuucuucaaacugcagaggaaacagaaaaacaacuuaaacuucuagaacuuguagccccaaugccaagcugauaagcaaccugcuaggcuaaagguagcaugaaguuuggugcugcuacagaagcagugauggcuccagguacccgugaggcacaugcugcuguugcaggcccagcagaucagucagcacuguccugggacugaaaguugcucaagaguuaaggauggggaggggugaugacuugugacugaacaugcuggaauaguucccuuucuaucuucagacugaaacagaggcaacaggagucauuugggaagagggacucucaacugagaaauugccuccaugagaugugccuauaggcaagccaguaguacauguucuugauuaaugauuacugggguagggcccagcucacuguauguggugucaccccuaggcuggugguccucagugcuacaagaagacaagcugaguaaguuaguaagcaguauuccucuauggucucugcaucaguuucugccucuagguuccuaacuuuauuuuccuggaugauggaagauccagguaagaucaaacaaacccuucaucccgaaguugcuuucagugaugguauuucaucacagcaacagauacccaacuaaaaccaaggcuaaacuaaguuaaucagcugcuuaguugcaugcaaaaacuuuggcauuucacaccucagauaguggagugggauggccuuuauuagguuucuuuuuuauauauuuauuuuauaagcauuuauaaaaucuugguguuuagucaaaacuaaugugaaaccacaaccaaggcucugugucaauuucucugucuaauaguuuuugaucaaacaauuucaaguuccaaacacgagcgguuccuuaagcuggucacucuaguaccagugauuacuagcaugagaaggccccugauuugccacuuagaagaccacucgcauauuccuuugagacaguaugaaagugcaacuucaaaaagccagaacccacuggccuccuggcacuacaaagcagcaaggagggaccgagucacaaaguagugucuuucccccauggcaucuaagccgguuucuaaaagacaggccuuuuguuucuuuuaagaucagggcuucccuauauagcccaaacuagucucaaaacacucaauucuaucucaaguuccugagugccagggugacaguuguacugcaugaauccaagggagaagcuacaucugaacuagcccaguguuauuaucuuaagauucaaguccauuucuuuccucuggagcuugagaaaaaaaucaucuggugggguaaaaaggguccacaccaagugcaccucccacacugacagggucagcugcuucccccacuaacaacccucuggucuugugcccaguaguaauguguuucuuuuuuuuuuccuuuccuuucuuuuauuuuuuuuuuuuaauuugguuuuuugagacaggguuucucuguauagcccuggcuguccuggaacucacuuuguagaccaggcuggccucagacucagaaauccgccugccucugccuccugagugcugggauuaaaggcgugcgccaccaugcccagcaguaauagguuucuuacacuugcuuucagugccuggugaguaaggcugcuguagccagcuccucaguuuggggguagaagagacuauguagacccucaccugcuauccuuaaagcauaagcucacaguaucacacacucucuggcuugaacaagaaaauccacacauauaugcacaugcucacacugcuggcuuaggccuuucagaccccaugucaaguaugaagaccacugaauugggggcaaacuuuccaaugacucuggcuaacuucaacaucaguucuaccauuauagcagcacaugucaguggugcacacaguuagcccuacugccacccaccaucuugagaaugcugccuuagaauuguugugcaacuagauuguccuaaaaccuaugccucugcacugcaggaaacaaccaaugcuaagcaguauccacaaguaucucugccuaaggaacaagcaagacuuuuugaagcuaacacccacaagaacaaucaggagagacagcccuccaugcaucagagacaggccauuagaccggccugaucaccucacuccccaucuaaagcaccaacagacucaugagcucuucaaaugaagguuaacaacuugacaucuauagacugugauaacuuggcaacaacccaagccuuagccacgaugagauccugugccaggucacauuaaaaguauagccuacuaaguaauaccuggaacacaucacaaaggguaggaggcucuggugcugggcacuacuaugacacaugcuaguauauccacuacuaguaacugucugguauggcccaaucuccauaaggaagggcuucuucauacuggaguuugcucaaguucucagguuuuccacagaacaguuugacccucagggucuuaagaaggcaagguuaaaugagucacauucuagcuucccacguuacugaggacugacagccucaugggaaauccccuuugccuacagcuucuaggauucuccuccccuuagucuacugucguaagcacaggagagcuguagggccuugggucuggaugaauacacagcucugggccuuccagguaagagugucuaagcacccacaggucuaagcacccagguaaccaccccucugccccacauacauugucaucauccucuauggccuccccagugaaguagaggacagcccguggcacgaugcgcucacgaaaaaagugcccaauuucaaagucagaggcuaaggugaacucggaaucuucauccugagaggaaaccaauaguuaacucauuucaguggguuaaagacacguucaguacaccccgcccucuucuucacccuugcuucugaaugaucugcacugcugaguaagucaccacauucaaagccacuuacaauggccuuaaagcuaauguucaaauuacacuacaaaauuccaugaaaacaauaaggcagguggguggcagcucugcugcauguccuaugcuucagaguacaggguuggggucucuacugaggacuaaagggcaggcauggaaaaaaacauucucaugagguccaagguauaaugacuucacuuuaacuacagaaacuaaaggagaaaacggaucagaaagagcaagugcuuauucaagaaauacuugacagaaaaucagggcuuuugacaauacaucuuaccagagauucuccaucuccagaggcuagaagaagaaaagaaaacacacuuauauuacaacgacaccaauguuuuaacauccacacugaagggaaaucagcuggcaagcagcucucucagaccccaacaaggcaccgagacaccuugugaacauuucacaagcuccaucuguuacaauuauuucauuuagauaaggcagugggucaaaaaagcugagaguuuaaaggaugagcaggagguaggugaaucagcugcccuacuggaccauacagagacugauccuguaugcccuucaaugcugaaugguacauguuuaucugcuauggggcaaagagaagaauguacauucugcugaugauccugcagauggguuugcagccuuucacccaaagaugaugcauccauaggggucuacaugcaagaccaucaaaguggugcugauauucaccaggucaaaaagaagaugugggcuucuugccacaccuccaugaaaccaaacaaccauuaccugacagauaauuuggaccuugacuagcaauagguuggaguagaucuaaugcucucuguuuaacuguggugucagcauuucucacagggcucaugucaguuguuguuacagccugacagcauucacugguagaaaaccacaguauuggguguaugaacaccaccuacaagaggcuguuaccauguaggcaaggaacagucugagggcuggaccccgucucccaagugacaagcaccacaacacaugccuuccaggccaauucuauaggcugaaggucaauguaguagugucuccauccuaaaaucuguagcccagccccugagcaccauccuccuuccuuuccugguccuagaacucaucacuguuacauguugccugacugaaauuguagccacuuauuuucuccucuucaacuuccugaaagcacuguuuacaguuuuauauucauuucccuuuaaaaugcaggcuggaaacugaauaagcuaauuuuagaguugugccacuauaaaacaucaccccuaaaaaucacaucugcuuauaagugaauuccacuuucacuguugcuuuaggaacacuuuuagggagcuaagcaugguggcacuugccuuuaaucccagcacucaguaggcagaggcaggcagaucucugugagucccagaacagccugguauacagaacaagucccaggacagccagggcuacccagagaaacccuaucucgaaaaaaacaaauaauaauaauaauaaaaaagaguaguuuuagggaacuuccuaagauagggugucacuauguaacucuagcuguucuaaaacuuacuauguagacacccgacugucucugccucccaaaugcuaggauuaaaggcgugugcacuaugcccaucaagaagccaacucuuaaaggcagggauccuccaccugagccccacacagccagccugguccaccauguaugucaguguguacucuaaaggaauuuccucacacaggaaacuugagcacuaagcucuuacuugcuaacagaacauacuuuguguuuuguagguucaaaguuaaaucauagaaaauggccauuacaaugacaucacccaaaugucccaugaggcacacaugguggacaacagcagcaagcucuaagacaaagcaaagccaagugcccagaucuaggacuggaccugccuaagguuccccaaacaacucuacauuggaggauaaucuuggcagcagggaugaauauuuauguccaaagauggucucuucauggaaagcgacaagaaaaugccucauacccauucucuaacacuaaggaaaggucuagccaagcaccuuccccaucauacaauuacugugggacugccaagauaggaguccccaaguggacugcaguuauuacuaggcucaaugucccaucuuuauuauauagcucagaaaacuagcaaaaagcuucaauguuauaauucuguuucuagucuuuaaaaauguuaucacauagaaauuccaaguaaagcccugugcucugucgaacuguacaagacuagggaaaacugaauuuauaagaaaaagaaguugggggcuggugagauggcucaguggguaagagcacccgacugcucuuccgaagguccagaguucaaaucccagcaaccacaugguggcucacaaccaucuguaacaagaucugaugcccucuucuggagugucugaggacagcuacaguguacuuacauauaauaaauaaauaaaucuuuaaaaaaaaaaaaaaaaaaaaaagaaaaagaaguuggacuggugacucagguuuggaacugugacuagcgugagccaggaacgguccugccuaucccuuccauaugccaaaaaaguggucaucuucuccugaggugcacacacuauuucuaagagcuaagcaaguaugagggaauggaacaacuuuacagagaacacagagcgagcugccccugcccaccuuucagggggcugaagaaguugaagaaggacucauugggcacuugcuuggugaugguucguacggugccccggcccuugugcuucugcuuuuucuugaugguuuugacugugacauuuuuuccuuucuuccagucuauuguacaccugcagagacaagguaacuguuauagacauuugccccaagagaaaccccacuacuguccaggaaggaagccagagccauauguaacaucugacaccacucaucugcaaaccagggaaaaggaccccaaaguccaucuguaugacagcuuacaagagcuagccuggucccaucauccuugaauaaccaaugcucaaaagccuuacagcucugaaaugacaacagcauucuuccacaauaguccauaaggauucugaaaugucuucugugcaagacacuguaaguccacagaaugcucaagaacucaucaccacuccuuaugccugagcacaccuaggguuaccacucaugcacuccaauucagaaaucaacuaagugaacaggacagcaggggccacugucucacuucugguggcagcugaaugauaucugcucaggaaaacaugaaaaagcuaagcccucuccuacaugucagacuggcccuggaaaaagaucuccccuaaccuaacccugaguacuccaagccuuuaaaucaaguagaacuugaaugaagcccaaaaucauuucgugacauuaacaacacugagcugguucuggugaguguuuuacuucaacaauuaauuuuccaaacagugagacacaaccacaggagucaacuucaagcugaaucuccacugagugaucuagaaacuuaacaccgucauuuaucagguagcaaauucggugccauauuccaaagcuguaagugaacugugacauggauuaaacuucaucaaucaacaaauacuuuuccucguaagaguuuggggcuuugcugggcacgaugguagcauagcauuuaaucccagcacucuggaggcagaggcagguggaucucuaagugcagccuagucuacagagcaagcuuuaggcaagccagagcaaccuaaugacacccugacuaaaaaaccacuucugcuggagaaauagcucaaaagaccaguuuuugcuucccagcaaccacacaguggcaucacaaccacccucaacuccaacuucagagcaucugaugcccucuuucaaccucugugggcaccacaugcaugugguacagauacaccugcagacgcaacacucauacacauuaaauaaaaauaaaucuuaaaaagaaacuuggggcugaggacacaagccccaaggacacuuggucuucuacguaaagauccuagauuuaauauccagugucacaaaaaaacaaaaacccuucaauuccugguugucuaaagaauucaaagccuggccccauucaaacagcaacugaggauaggcuuccaaguauaucugaaccuuaaggcacgacacaccuuccaguuuuagccauguccacacugcagggucccaacuauaagcuacggcagacaacuucugaagggcuuuuaagugguuccagacuuuaaaauauauuuuuaaaaaaauuauugcuggguagugauagcacacaccuuuaaucccagcacucgagaggcagagacagguggaucucuguguucgaggccaaccugguuuacagagggaauuccaugauggagaaacccugucucaaaaacaaacagaaaaauauuucuguauaguucuaaguacaaacucuguguguguguguguaugugugugugugugugugugcguguguauguuugacucugcauacaugcacaggccagaugcagacagaagaggguaucagcuguucucguccucuccuaacacucucacccaauccuuugaagcagggucuucuugaacccagggcuccuguuuucuugacuaggcugaaagcccacaauucccagcaaucuuucuguccucuguacccucaaagcugggguuacagacauguggcuuguuauauaagugcuggaguuugaucucugauccuuagucaucucuggccccuaagacuuuuuuuuuuuuuuuuuuacaucauucucguuuuugauauuuuucuuuguuuuacagagaucuuccuguauauagccuagccuggccuugaacgcucaugcaccccuacaucugacuauuuuaaaauucaaaaccauuacugcuguuguugcagaaggacauguucuuacccaucacaguccacaauuucaggaccuucaaaagaaaacgggucggccuugucuggcucugauuucaucuuguacguuuucgucaggacaggauuggugaaguagucguuggguucaaagugaaacucuagcacaaaagacugaagcaaaaauccagaguaagaacuaccuaacaucugcacaaagaacuuaaggaacuaacucacaacgcauuacauagcccuucaacaugggcuauuucaccuuguaugaaaucuggaucagauuuuguguuuugcagugagugaaaacaggauccuucaugggagguaaauagagaagacaguguuagcugcucccuugaagcugcacaguaacucacagaguacacagggagucaauauuugcagaaagacagguauaucaaguccaauggcaucaagaaaaaaacuagccaauucacaaauauauaaacaaaaaaauaaaggaaaugggcagugguggugcacacaccuuuaauucuacuacuugggaggcagaggcaggcagaacccugaguucaaggccagccaaggcuacacagagaaaguugguuuaaaaaaaacaaaaacaaaaacauacaaacaaaaacaaaacaagcaagaugauuuucugaggcaaaauguaccaaaacaaaaaccucugugggauuaggcaaugucucucggacauaucaugcaaccaaaauaauuaaauaugucugaccuccauaaucaucaucugugauuuuuuuggaggaggugagggugggggaacaguccacucugauagagagaaugaauaucuuguguguuguauagaugcaucaccugucacuuaaaaagccuauggccuagacaggaaauagagguggaacaucugggagagaaaggauucugggauaaagccagaagggagacuggccaggaagaugugaggacacaugguaccugagcauaggcaaccaggcacguggcagaauguaagcaggaaugaaugggauauuuuaaguuauaucuagucagagaugagccuagcuauaugguaaagauauuuguaaauauauuuugagucuauaucuuacuucugggagcaugggacuggaaggaagaacugggccuaacuucaaugcacucuagccuagcugaucaugcucacaguaaccauugccucagcaggaguacagccccaacuaacaugcagaggaagauaagauuggcugggaauggauggaaucaucagaaaucaaacaagguacuaauaagaaaaaaaaaggagagagagagagagagaaagagagagagagagagagagagagagagagagagagagagagagaaaccugaucuagcugagaguaggugagcuuguacuuuauauucuaagcaccuggaaggcugaggcagagggagagugccaucauuuucaggccugccugagauauagugugaauagucuauuucaaaaacaaacaaaaaaaacccaaccagucaagguagcauacgccuguaauuccagaacaugaggagcagaaacaagagggcuacaacuuugaaaucagcuuagucuauauucuggguuagcccaggcuacacuacaagacccuauuucacaacaaugaaauaauucauaagaagguaaaaguacaauugagacuggaugaacugaaaguaaaaucccaccgagcaucuccaaucugcccauccaggaaagguagagaucagguagcacagccagagcuuugggugggaaagagcuccuguggccacgugaacaagaggcaaucuucagaguagacagccaaauguuaacguuuauaaaaggaaagugggaugggauguauacagcugccccuaaggacugauaaagaaaucccacccacuguccuaucuccaccuguuaaccagggacugggauagaaaugagaaaauuaaaaccucuagcuuccuccgucaagaucccuugccuaucuccuuuuagugugucuccaagaccugaaacugaaagccacuagccagccagucagucaugugucacuggaaauccuguagcacuggaauggaacccaccagccacagcaaggcugacagguuacgaacagugcugaguagaaggugaggcccagcacauccuaguaagcccaucuucccagaggccagaccacgucccauguuugaagccauuuugggguaguuucagucacaucuacauuggucauuuuaaggaaguauuuuucuuagaaucuggauuucugaaccaguguuguccauguuuguuuauguuguuuccauucuuuuaagaagagaccucaagcggggugugguggcacacgccuuuaaucccagcacuccggaggcagaggcaggcggauuucuguccgaggccagccuagucuacaaagugaguucuaggacagccagggcuaugcagagaaacccugccucgaaaaaaaaaaaacaaaaaccaaaaaaccucacugugcugugacucaggcugaucccgacuccuauacucaaguaauccaccucccuucucggauuaugagcccaugucaccauauccugcuacuucccaggugacuccuaggaaaaguaugguaugucaaucuucuccaccaaacaagaaaauccagcaacugaaucagaggaugaccaggugauaaccacagcccagcagucaaggcaaggucagcguggcaccagccuguauucagcuggcuacucagcuuugggacaugauaugguccauguuauuggcuaaaugugcccauuaccaacugcagcaacaagagaagucugaugagcaggcauccucagggcugcccaacucuugaguaacaaaaaucagaucuuuugcaccuuagucaacuaguaaggagcuuggucacuacucaccauagguuguccagggucugaaaacuucacuuuaauauccugcagauguuucaagaucgguucaucauauuccuaacaaagaaagagagaacccugaacaacaguccaccccucauggcagucauagcugcaugugccccagaugcuggguugucucuauuggcauccugucucuguccuguaguaacuucuggaaagcaaugccaauuuguucacuauguaucucugguggcggcaguaacacaccaagaaucagcugccaccugucucuagagugucaucaaugcuggcuacagggaagucccaggcucuccugccaccaucugacccuacaguuggcacagugccaccaaccaagacuucuggccuccaacaucuaaaauagcaaaguaaaaggcuuggcaucaggggagauggcuaaauuagcugcuggucuuccugcacaguauuaacuagggacaauuaauaucccaaaucugcauaugccacuucuguaagaacacagaaaaugucaaagccuaacauauaggagccaacagcucccuuugcucuaugacuuacaaugacuauugcuuagacuuguacaguaaagagccuacaugagaaaaagcuaaaggaaugaagacuuggauaccugaaaugacauacuacuuacagguuagaaugguaauucauucacccuaagguugacauugagucucagaauuuaaaguuccaaaccucuaagaacuaagcccacuaaaggccacgccccaauuuugagguuuguuuguuuuuuguuuuuuuuuaacauuacagaauaaaaacaaaucauaccuauuagcuauuagaaaaacaaaacaaacaaaaaacaaaauaaaaaaccagaccacaccaaaagcagucacaugucugacaccaauaaaggugcaugaaccuacacuaauaugccugccaugcuaugcaucugaucugaauggccaucccagcagccuaucaugcaucuacugccaccccaaaugggaugucugaacaucagacgagaaccaauauggagguaugagaauaaauacaugcacauacacucccauuaaaguaccagcacucucuccaaaagcaaagcaaagcaauguuaccaacaaguccuaaugcccccaucccucacguuuaucagagcugccagaaagcugaccagaccacacauacaacagagugacuccaagagauaagcagccuaguaccuaaaugcuauacuggaagcuauacccucauuacaacugaguuuuacuugguuuauccccaccuagcagugugagcaacaacacccaggagcacaaaagaaaauacaacugucccaccaaccugacucaaccccccccccuuuaugcauacuucccaucccauaaagccaaacaggacuaugagccaccuggggcauacauugaucaugugaggagauucugaaaacaccucuccccagauucccuguguucacaggaggaaccuugugaacaaggcuuuggugugcaguucugggcucuauaggagguauaggagagaaaccucucaagcucuugugugggcagaauuauaagccuugccaaguaaugccaaagaaaauucagccuucuucaacaaaggucuuuagagcaccgagggaucagggcuacugcccaagugccagcccccaaaaggagacuuuucauucaucuuaaaaugaaucccgccgggcggugguagcacacgccuuuaaucccagcacuugggaggcagaggcaggcggauuucugaguucaaggccagcuuggucuacagagugaguuccaggacagccagggcuacacagagaaacccugucucgaaaaaccaaaaaaagaaucccagcagcacccaguuaagcagcgaguaaccaccaccagccaagcucucaacauacaagaaucgggcaucaccccagucucccccaacccaccugcucaccagguagaagcaccucaccugcaccagcucacuaagcauguccacauuucugaagauggugaaccagaacucagggaugccuuugggguucagcucuuccacuguugcugcuucuuucucagcuaugacuacuuuauucuucauaucucccuacaaaucagauuuuaaaagucuuugaaauauggaagggaacacagccccaggaggaagguagguuaaaggaagcugaaccaaauggauucugaaugcuuaucaugaugccugguaagucagaacaacaugcagagaucuuuaaaucaucaaaaugggcuuuucuuggaucauuaggaacaaacuaauguaaaaccacagcuucaaccaaguucugccaaugucuaaaagcagaacacuggcugggugugguagcauaugccaucuaugugaguuuaagaccagccuagucuaacaaugaguuccaugucagcccaaguuacauaaugagacccuguuucaaaaacaaacaaacagcuggcauuacguauauccauaaaaauuaaacauauuuccaaaaagaucacugaaagauaguucuauugaaccaaagcuaucuguuaucuaaacacaaaauuaggcagacagaggcuuugguguaacucggugguagaacacuugucuuuugcaugugugugucuggguuacaucccuaguaccuuaaaaaaaaaaagcaaagcaaaccuccagaauacaaguuaaaaugaaccuuguaccaugcuagaacuuuccaugguauguggaugagacugucacagaaaguggauacaaugucaugaugcuggucaaucaguuaccugauggucuaaagacagagugaggacgagcagccugaggcuccagauggccccucgauacacgugccuuccuccccacugaggaggaagauguauagcucccacccauuguaacccccaccuccucuagccuuggacucucauugauuagcuuuguucuagagacagagucucacuauguagaccaugcuggccuggaacucaagaaucugucugccuaacucucuaaugcugggguaaaaaucauguuccaccaugccuugcacacuacaaccaauuauugccugccugaucuguauuucaacccuaugcugcacagaccacuaagaaagaguaguaacucacuugucauggcaacuaagcacaguugccaugugccucagaugccacagugucaucauaaacucaugcacccaguggagagaagggaacuacuauagucccacucuacaaagcuuuguggacagaaaccaugaagcagagcaagcccuugaggucaucuccuaauaccacaaaaauaacuaggauuaaacaacaguguacagcagaaacuuacagccaacuuguccuccuccucauucucacugugccacgcugacucugcaucugugggcuccacgucaccagugaugaauucucuucucuacauaaaaagccaagaguccaucagcacauuaggcucucugcaaacucaaaagcuaagauguuuacacggaccucugccaagacagucaaauucccugggugguaccgugucucacuccagagucacugcaugaagcaagcacauuaacagcacgcaccuugucaaauagaggcugguacaaggcugcauacuuccucuccaggucaugaacuuccucguagaacuuagcuucuaugugcgcacaccucaccuggagcugcuucagggcauuaauucuucuuuugacagcuuuagguaaacuacaagagaacaggaaauaaaacaccuaguaccagcaaacaacuaaauauacacauacaauaagcacccugauuagaaagagcugcuaaaacccuacuugcaaacaagccaacagaaaagaauggacugcuugcugggcaagguggguacaagccuuuaauuccagcagaggcagguggauucucugugagcacaaguccagcccaucuaccuaacuuaacaaguucuaggacagccagggauauauagaaagaccauaucaaaaaagaaaagaaaaaaaucaaucccauaauauaucaaaagcagaaaugggguaucaguuuacaaaauugcucucuugucccaaccaaacuggugaugaaaaacagagcaaagagcacauuugcaaucccaaucacgugggaggcuacaacaauaagaguugcagaaguugaaugcuauucugggauacacagagaccaaggaggaaaaguguaggucaaagguagcacagcaaccuaauauacagauauuguccaauucccaccacacacaggcacauacacccacaaacaccacacacacgcaccauacacgaaaaacaaaacaaguggggcucugggcaugguguuaugcaccuauaaucuuaacacuugaaaaguggaugaagaaggaucagauguucaaggcuuguuuggcuacauaguaaauucaagcucagacuaggcuaccacgcaagauuuuaucuuucaaaaaaagcaaagacuggggcuggaauggcucaacaguacuugccacucuuacagaagauccgaguucaguuccuaacacucacgcugagugacuuaaaauuacucuagcucuagggaaaucagaugccucuggugucaauguguaucuguacucaagcgugcaugcacacacacauacacucauaauuuaaaacaaaagcccaccaaagagauggcucaguugguaagggcgcuugcuaccaagccuaaugaccugagaaguuagguccgugagaaucacaagguagaacgagaaaaccaacucuuuuaaacuaucuucugaccgcuacauacguacaacgggaugaaauaauaauaaagagcaaaagcagaacucccacacaaggacuagacacaggcuggcugacaaggacucgggcauguaggcccugaugcuagaacugaacaugaagucuauggacaaccucauagaauucucucuccuaaucguaccagcuaagaguuucuuugccuugguuccacaguuucuuuucuuucuuuguaugagcacuccuaaaaucaaaaggaaaacaaacaaacaaacaaaacaaaaccaugcaggggaagugguggcacaugccuuuagccucagcuugcagguggcagagauaggugaaucucuugaguucugaagucagccugguuuacagaguaaguuccaggauaaccagggcuacacagagaagcccugucuugaguaugaaaggaaagaaaaaggaauuuaaccuauaaaauuguuucaauuaaaaccugaaaaauaaugccaccaggugaaaacauguucacaguaaauuugaauacagguccacauaaacagccagugcuggcccaacagauaugugaggccauguucucacaagcuaucaucacccugugccugucucaguaagcaaaaccagaaaaccagacaccauucucaaaccccucacuauauccuaccaccuacuccacaaacaaacaaacaaacaaacaaggaaugccaaacagaacuaaaacgaacuguacccacugaguagaguaaacccagaaagguuucuaaauggacacaaggaaugucuccuccuauuguaacagcuaagccuuacccaacuggacauggagccugagguggcucauuucuuccagaaggcaaacagggaggcccugagaagcaaugucucauuucuaccauacaacagagccaggacacaggacacaggcuuccugacaaggguaaaaguacaagugucccacaguuggccaaauagcacucuagcuucuuagcugagucgucuaccagccacguggugguacugugcacuaccaagcagacaagaggagcugcuccugaguuaugaauaacacaauugcugcuccucuaagacacaaagauauuuguucuguugcuuaacuggcuauggacuuacguuucuauguaacuagaaggagugugagagacguugucaagacguuccugcaaagcugccagcacuuguggguucugcaucaccuggucugugaguuuuucuaugaggaguuggaaaugagaauaauuauuuagcagccuagaaccccaacaccaaccuggaucucaggcuggucaacccagcuacucaaaaggcuaaguaaggaaaugccaugccagaccuuccuuaucucaaaauaaaacacccacaagaagcugggcgugguggcacacgccuuuaaucccagcacucgagaggcagaggcagguggauuucugaguucgaggccagccagaucugcacagugaguuccaggacagccagggcuacacagagaaacccugucucaaaaaaccaaaaaaaccaaccaaacaaaaaaaaaacccacaagagugcuggacuguaacucaauaguauacuacuugccuagcauaugaagcccuggggcuaaauccuuauuaccacaaaugucuguuagaaauaucagcacaggcuguuaucucagcacucagaaagaagaggaggacaaucugaauucugggguuaaacuacauaaugaguuccaggacagccagggaugcccagagaucuacaaagagauaucucaaaaaaaaaaaaaaaaaguaguacacaucaccuagugcuuuuaagccagaauuccguauaagaaaagaggcuuguguuggguccagauaagaagaaacuguagcaucucagaccacacuugcuuuaaaauaaacaaauauaaaaauccccaacacauguuuacuuaucuuugcuccuaaauuucuaaauauaguaaaauacuuguuuagagacuuguaucuuaaaaguaucuuuugggggcuggagagauggcucaacaguuaagagcacugacugcucuuccagagguccugaguucaauucccaguaaccacauguggcucacaaccaucuguaauggggauccgaugcccucuucuagugugucugaagaaaacaacaguguacucacauacacgaaauaaauaaaucuuuuaaaaaaaaaaaaguaucuuugggaugggggaaugggggcagggugggagaggcagguagaucucugaguuugaggccagccuggucuaccugaucuagccaguuccaggacagccaggguuacacaaagaaacccugucucgaaacaaaacaaaaaguaucuuuguuaaucacccuagugggcagguggcgacagaggcuccugccuguagccagccuagguccccaagaucacugacuaccaacuuucaggggcugguaauuaacucugguuacaccuugcuccccagucccauugguguuggaagccagggacaaggacaagauuagcuucuaaagcauucacccacuuaguucaaagagauggcuuuccccagacugcccucuucccuagaaagccguuuccccacccaaaccuaccugcaaaaaguacucugaccuucucacaugccuuuguucugaacuuguaacacugaacuauuauuuagaaccugccccccaccccccauaaaaggagacaccaagagaauaggaacuguccuucacuaggugauggaguugaacaauuccucucuuauacaauccaggcccaccaggaacuuaagauucuccugcuuggacucccaagugcuagaauuauaugauggucuacacagccugcucagagacaguuaagauuuuuuccauuuuaucauuauuaguguguguauauauucaaucaaaugugcacugaacaugacugcaugugaauuuacauacacaaacauacuucuagguuuugcuucagaauaagcaggagaggaaaguugggugcuagucugguuaacauucugacacuuaggucauuuauaguaacaaacugguucuggagaagaaacccucucuaaucacugcuucauccacugcacugaccuguauuacuggcauuuuuagcagcuuccacagaaucugcagggccuccaucugaaagacuaaaacaacaaguuuacaaaguauuaugaacagaaucucagagauagaaccaauuggcauuuucaguguuuauccaauguauuagggucugucuguacagcaagagacuccaggucaggugaagacaacacuagcugggcaugcugcaccaugccuuuuauccuagcacuugagaggcaacagcagguuuaucucugugacuucaaggccagccuuuucuacauaguaaguugcaggacagcuagagcuacacaagaccuugucccccacggacaaacaaacaagacaacauggucacaccuguguuauuuaagggagacuuccucccaucuaaacagaucacacccacccagcucccuuuccucacacccaauacaaaggcugcucuaaucuauaacccuugccucauuuuuaauuucuaaaauuaaaaaaaaauaccuuguaugugccaugcauggugauauacaccuucaaucccaacaccugggaaacagaggcagguggauuucuaggaauuuugagccaugcuuguguacccagggaguucuaggccacccagggcuacuacacauugagacucuguccuaaacacaaaacaaaaacaaaacccaacaacaaaaauuauguuuaugaguaugucauauguggauaugugcaacgccaauggaggccagaagaggacaucagauccuccgaacuggaguuugugagcugccuaaugugggugaugggaacaaaaaguuaagucuuugcaaaagugguacauauucuaaaccauugagccaucucuccagccugcuaauuuuuauucugacagucaaucucuugaugauauaacuggucuauagugcuuaagccacuucacuggaacaacaagcuacccccuggucagcagagcacacaaguggccuuguacagcagaugcaacggucacagugcucugccaaccaugcagcaucacuaaaacaauggcuucacaaacacaagccugacuggcuaccaaagagccauguauaccuuccugaagacaaaguucuacaagcccuuccagugcaucucugggacaugaaagcagagggagcuaugggaaaaugaagggcaauuaugaacaaaauuaaugacauacauguaugaaaauggcacaauaaaauuuauuauuuuauauacgaacuaaaaaaaaaaaaaucaaaacaacacucaaccaacacugaccuugcauaucccacuaacaauccuuucccugaucccuggcagguaugucagauuaaugacaugacuucaccaaggguggggaaacagggauuaaaggcuagggagcacagaaacuucaccugagacagcuggugagaucaauuucuuugccagcaaaagggagaaaaaaggacauuaccacuugaaguuuaaacuaguuaacuuugaauccuagcuucugaaauauagcgggcucuagcucaauuccuaaacuuugaaaucuaguaaacaaaguccauuuuggcuuaccuguuuucugccaucugaacgccuuuguccccuacaaaugagaaaguucacaauuacauucacacacacacacaaauguucuauuacucuucccgcaucaugauggcacuccaccagucauggcaguugagaccuuuuugcaggugaaggaaauggaaaugcccugaugugaccugaaguuauacgagcagguacaugucuaaucucauagacagguacacuuaagaucuagguuucacuagacauggugaugcaugucuuuaaucccaaccacuggguggcagacacaaauggaucacuugagucugaggcauaaagaguucuuggcaaauaaugcuacacagugagaccaugugaaaaaacaaaguuaaaaugaaauggaaauuuuuuugagacaaggucucauguagcccagacuggccuucaauuugcuuuguaguugaugacccugcaugucugacccucagccuccacauccccaguacuaggaugacaaguauaugccagcaugcuaggcuuaugcagggcugguauaaaauccagggcuccaugcaugcuacaaacugagcuagauccaaaacauucuuacugacacuaaagugaccagacuucacaguaagaaaacagaauccuaaucugccuucucuuuacaguaaacccgacagauccacacagcaacuuccucaaacaauucaaaagcacauuguuugaacugucucucacauagacagaauaaugcuaaucuaucuuuuaugccaccuacacuguaaaaacacuacgagacacucaacacgaccacucuguaagaauacuugaucucuagcagccgacuuacuucaagagaguaugaugaaugagaaaaagacaaccauacaaagccccucacucuugccaaguguacauaaugagaccuucugaaagcuauacuccugcuaggaaaacaggagacaggaaaaacaguuccagcaagagugaugggcaacugucucacaguuaacuagcugaauuuucuauuagguuuucauuguuucaaaauaaaauaugugcaggugguucaugccuuuaaucccaggauuugguaggcacaggcaagugucuacauauugagguucaggccagccagggauacacaggaaauccugucucaaaacaaacucaaaaugcacaaaaacaugucacaugucuuagguaggguuucuaucacuacaaugaaacaccaugaccaaaaagcaaggggaggaaaggguuuauucugcuuacauguccacauugcuguuaccaccaaaggaagucagaacagggaacucaagcagggcaggaaccuggaggcagaaacugaugcagaggccaucauggaugcugcuuacuggcuuguuucccuugguuugcucagccugcuuucuuauagaacucaggaccaccagcucacuugugaucccaccuacauuggggugggcccuccccgacugaucacuaauugagaaaaugccuuacagcuggaucucauggaggcauugccucagcuggggcuccuuccucucugauaacucuugugucaaaaugacacacaaaaccagccaguacauaugacuaguuuuuuaaaauuuaaguaauguaugaaagcacaaagaguaagacaacaacaguacugcacaugaccaaacccagagcaacacagcagcuucccacacucagcuucaccuucaacgaaccuuccucacacccuagaucuuugcaguccaaacucacuggccacugauguacauuccuacaucuacccuacaaagugaaccauucucaauuccagaaaacacuugcccagauguccaacaaggcuuuucuaccguauacuuuuguuugaggucuccauugaacgccuuagucaaaugugguuugccaccccuugcuauucuuaacuuagauggcaagauuuucauguaacauuucuggguuacaagaaugagcaauaaacacugagcugguuacacacaagcauuccuuacacuuuggcuccacaguuacaguaccccauuaccuaccuauggcuaacagcagcuucucuggacugcauucccagcccaucacccuuucccauuuguacagcaauccucaguacaucagucucaccaccaaagacugagaagccacgcccacuugaagcacuacagugguacagcaagucagcccaucucugauacauucauauagacuauccugccccgugagucuauccucugcacacugaaaccaaggcaaagugccagcacacgcuccagcaccauccauuacuguguuuaccaaacacugaaagucauaaaagaguuaugcaggugucgagagaaacauccaucuuguuuuuaagguuaaaaugacagguuuaauaccgguuuuaugacucuauagcacaaagccuuauuaggcaaacuacuuuuaaaaggcaucaagagucagacauaaugaugcacgccuguaauuacaggacuuggaagguaugguuaugcugaagcuagaggcuagccugggcuacaaaagaaccugucuuaaaacacaaaacauacaaaaacccuaacgaucaaguuagaucaugacagucaucagugauacuacuagaauacagaacuuuagguucauuuccucuuuuugcuccaaacaacaaaaaaacuuucggaaggaaaacauuaaauuuuuauagcaaauuuuaaacuggccacuucuuaaagauuaaaaaaaccaaaucaaacaaacaaacuuuuuaugcauaugaaugccugacugcauguguagcauauaugugcaauacccaaagaggccagaggagggcacuagauccuccugcaacuggaguuaugggugguuuugagccaccacauaagguaaugagaaccaaacccauguccucugcaagagcagccagugcucuuaaccaugaacaccuaaacugccacucccgaaagacaaagaaaggcauaaacuguggaguggcaucacacuucacaaaacccacacuuuuauauauuaucugucuucauaaaagccaaaggucuucaaagccuuaacacaagauaagcacaugauuacuauaaccuaaacuggccuggagagaugggucagugaauaaaggugcuugccacuaagcccgauaaugugaguuugauuacugagucccauauggaaggaaagaacagacacccauaauuauccucugacuucuacucccagcacauaugcaaguaugugcacggauauaaaggaucuaaaacacaguaacuugguucagucugaaagauggcaggcugacccagcgaagcuggggacguguaaccagguccuacaggaguacugacuuacaacuuaggaucaugucaaagggacaaaggaaugacauguuuuaagaaggaaucaggaaaggccuccccacccccacuccccggggagguuguuuaugcuauacacauggaggucagaagacaauuuucaggagucuguucucuccuuuuaaccaugugaagccagcagcagacaucuuugccagcugagccaucuuguuagccuguaauauuuuuaagcaaucagauauacauuagauuggucacugaaggugcuagguggugcuuuucugcuugcuuuugaaacuucucauuagugaggccaaggaccaaagaagaaaaacuuccaggagggcagagcauguccacugacucaaugcagaguucagggcuuagcaaaggacuuggcaugaaacagguagccagauaucuugucucaguuaaucccugcauguaagaaccacgguacugaacucccuuugaacaucuuggccuauccuaagcaauuuuggaagacacaagaugaggacauuuccuuagucacaucugcuuacaacauguacugaaacaccuccagcagaaaacagcaggucaucucaccagagauuucuagaagccaaaccaccaggcuucaggaagaaaggacaaaaugauuuuuuuuuucuucccucaagcaaaaugcuccucuggcagacgaaguaccucggcagcauuuggaaaaguuaugaaaauaugaacaagcagauauuaggacaauuuucuuaauucagcacuggcuaucucuucuuguugcuaagaggcauuuucuucccccauauuugaaauuacaaacuaccuuccaagacuccagugucucaaaaguauccucccacaucugacucucaccugcucccgcugcaggaagggcaaggccauucacuauuugcuuuacacuggagacccuaggcuggagaucuugcaugaauaauacacguuacucugaagcaacugaaugugacuuaaaucauaaauauaauaauuaucuuuuuguacauaaagcucagagcuaaucuuaccucacuagacugagucuccuggacacaggauggaagcacauuguuacaacagcugacagaacacagaaaaaaggaauuuaaggcuguacagcaagcagcuagaaucaaaagguaaaguucacaaagccagcuucuguaguuuucacacuauaaaaauaccacaugccuccuguuacugucaaauucaauagcagagcaaaguaaagcagaugagcuuccucucaggagacaggagaccugacugcuagaugaaaacaaaucuaugcuaccaucaacugucuucaaaaugccuaaaaauccauuccaagacucugcuauuuacccauuuuuacccaccaaaacaggcuuacugaucuaugauuaauaacaggucccaaguguagucuacgaagccuccauacuaccacuaucagguagucccuagcaaaggcugaggguagaaggaagucccugcuauuucccuaguaccuuccucuacuuuggcaauaggugcagcaagaugaagaugacaucagcuucaauucuaaaugccuaaaugcacuucaucuuucuugcaguagcgcuggcuggccuugagcuuccugcuucuaccuuuuaagagcuggaauacagauacaagccaacacacccacuuacauuuccuuuuaaguaaacaaaaaaaccuuguacucacgggcuagaaguccccaacagcucauuacuacugccucuuuuucaaaacaggucaccuggggcuggaugcaagcagcaaagaacucacugaugugccuauuucacacugagaguugcccuuagaccuucagauuuaaacuacccuuucuuaaauuucuaacuuauuuauguguaugggugguuucccugcuugucugugcacuacuugcagaggccagaagaggcuguuggaacccugggacuuaaguuauagacuauuagaagccaccuuaugaguaugggacucaaaccuagguccucugcaaaagcacacaaugaucuuaaccaccccuaaauuaacucucuugucuaggauuuuuuuucuuccaaaaaccaaaauuuuagguacuggcaguuaaauuuuuauacaaauacaacauaaacuuuuauacacaacauaaagacagcuagcagggacaguauacuuucacuaacaagaggcaaacaggaaaaaaaaagugagauaggaucuugcuguuuuuccaagacagauuuuaaacaguuccagagcaguugggaaucuagguguauacugccauaucuaucuuagcuggggcauuuuaagacucaaguacaaagucagaccaaaguggugaacuaccucauuucuaagaauaccaccccugcaggagauuuauugcccacugguauauucuauauacucaacuacacaaagccaaauggccagcucacaagccaugauuucugagaagaucccaaaauacauacauuuucccccagaacuuugguaauacaauuccagaauuuucaaaaaacgauaaaaucacuauuauuuucaccagcuauucuauauuaacugugaaaaacaguucgggauuuaaagcuaaaacaucaaaauguguuuaaauguuaugacacugugaaccaauauuggucaacuaaggggggggguugagaccgacaacugaguuuuacagcaucuacuuuaguuaaaaugauacagcuguagacuacccgacaggugaacuauacucuaguccuaucaaagcccugcuuucucugaaucuuacuguucaucugaauauuuguuucaauacguuauuuauuuaauaauaaacauuuauuauuaaaacugagccagauuaaaucuauuugaauuuagaugcaagguaccaucacacuuaaccuaucagggacuuaauuugcaauacaggucgaauacuccuauaccaaaaaaaaaaaaaaaaaaagaagaagaagaaaagaaaucagaacgucccaaaacccacuucuuuucgagcacauuuuggauuuccagauuagguacgcucaucugucagaccuacaaauauuccacaaaccgaaccacuucaaaacccaggcguuucuugcuaaugcacagucagccuguugcaccuacaucacguacuauugugaaugaguuaagacacgucaggagcuuaaaggagccccugguguguaguaagcggagauuagucaccgagaggaagcaacuacuaugacaggaaggcggcaguaacuuaaaagcauuuaacuuuuggaccaaaaacuuaaacuugagucuuuuugcuguggaauaugcauaugcucguuaccgcagcgcacgcgccggaagcuaccgcggaaauuccuccaagaggcagcgaagcagaguuggaggaagugcgggccaacuugccccaaggauacccucggaagaagggguacugcugacgacccugaacccguuaggggcgcccgggucugaaggcucagugugugucacuaggcuggcuccgccuccaccgcaggcucagagagugaggucuggcucagagaccggggcacugugcggagagcaugcaaagcccggaagggcgaggcggcggcccaguagaccccuuccuucccaggcgcggucugagacgaggcguacccaggcccaccucgcuggggaggccuuguccucucaaggaaccgccugcgccgcuucgcguggguucucgggcggcgggaacaaagcgcgcugaccuucagccgggggcggggcugcacggaggagggaccggcccgccauccgccgccacccgccacccggaccucugacccggucgccgcccgccucugcucgccgccauggcgcgucggccugcccgcgccgcccacuccuccccgucuccgccuccuccgccccagucccucgccagccgcccgccgcgccguuacccgccagcaccgcaccucgcgccuccugcggcaguggcgccuguccuaagcucgcuccggggcu

SEQ ID NO: 12410 - RNA, 7186 nt, Mus musculus
aguuaacccagcggaggguggcucuucucagguuagucgguuugaaggcagcgaucuggaggcucguccggccccggcgugucucgaggagcaggcuagcaccccgcgguucccggccggcgugcggcuccgcccaguagguccgccaccgagugucaaacuccuaguaaaguuucgcgucgccggucuccccugcccaggcgaccccgccgcuguccccucggcgacccuggcccccagcgacaaugacaggccacgcccccgcgcgggccggccucgcggcccgccgccccccggcccgggacggugaggggcgugaaugcggugggggcggggccgccuccgggaggagggguggcggggcgcaugcgcgcugcgcgcggggcugaauguuucccaaguguuugaaacugguauuuggguuuuccacguuggacaagugcggcgaggcgggcggcggagcgcgcccuucccgcagccggccccgcucucuccgcucuccacgcugguggcgggugggcggcgguggccggcccucuuugggugugugcgcgcuaguacgcacggccccccgcgccgcccgccgcccgggagggggccugcacggccggcggggugugcgcuugagcuucggccgccgcggcccgcgccugcaggcgccgggguccccgcggccccggaggcggcgcggcaggcgccagauguagccgccggccagcccggccggagcggcgggggggcgcggaagggcgagagagcuuugcauuuugcagugcuguuugaggggggcgggggguggaggaagcggaaagccgccgaaucgccggggaccuccggggugaaccauguugaguccugccaacggggagcagauccaccuggugaacuauguggaggauuaccuggacucaaucgagucacugccuuucgaccugcagaggaacgucucgcugaugcgggagaucgacgccaaauaccaagguacggcgggugauggaugggcgggggcggccgcguccaucccugggucccggcggcgaggcugaccgguccugcuggagccggagcgcccgguagcguccucggagggcuaggaacaaaaggucuggagcgccuuugauacgccgagguccuuguguaccgagcuccgggacauggagaaggaaggagcgcgaacggcuggcugcaaggcugcgcgaccaaagcgcucuuuguagugaagugaugaggcggugcugcgggggagggggcgcggggcucggccgcguccucggggagggggugaaggcggccgcgcgagguggagugcuaugcgggcgccgcggccguagggcgcgggcaccgggcuagagagagggcugcgggccguacuccggcggagcugagugcggguccggagagucgccgccucccgccagguucugguucuaaguguuacauaaaguacugggcaguccugacucggggucgcgcgaucgcccaggcccugcucuccugggcccucucuuggcucuggacagggcuccgggccgacugcgaggggcgccggcgcggugugucuuggggaggaagagggugaaagggaggaucgcagccgacuagguguacgacugcgcugcgaucgguggacgcgagcugggcucuggcuggagaggagcggggcaggugagggaccugcagcccacccgaagacccgggcugcccagaguggcgaagaggcggagccugcgugcccgccgggaacuguuggcuguuggggaaacuuugcugugaggucagggggcucuguuuugaacguggauggccgcucggaguuuacucuuguuuacagaacugcgcagcagggaaacggaagaguugggggugguggagggccacugcccagcacugcauacagagacuugcuggggaaagcgccccugcgcgcucuauccgagaugcagcuucgcagcucgguuuauaggagaaucauuagcauauugcggaacguuccgccucugcggcccuuugauuggucgcaacaucccccguggaauguccuuaucauugugcuacagagucauuggggggcgggcaguaugggggcgggcuuugcucgggacucgcuccagucuguguuuccgcugucugcuuuuuuuuuuuuuuuuuuccucugguagagggccgggcggagagaggaggugaguugauuugaaugucuucgggucgcccguccucuggccuuggguuggcuccugucgcugcuggggcgggccaccgucgcuggcucugcgcgcugauugguguaccuccuggucuccgcccucagcgucgucgacucacauaggcuucgggcggggcggggcagggcggggcgcgcuuccugagucucguaggcuggaguggaucgcggccacuuuccggcugcgaggcuauggcggcgguggccuccgggaggaugcugcgcuuaccuucucugcucuggcuccccgcgggagccucugaucgcuugucgcguuuccgguaggcuugaaugagcgggagugccucugucgggacugcgggucugugugucccgugcuguccuccugcgggcucguguguccgaauggcucuagaauauucaaguccuugcucagaacuacuguuggcagaccgaguuuuugacggccgccuuagugcuucagauguagaagaguucgaaaggagggucuauguuuugguuguuguaaauggaguuuguugcuugaauuacuuuucaaauauuauagaaaauacccccaggaagcaaugccucuuucuuaagcgcaaccuuauauaaaguuaaaguggcuuaaaguaauuggacagauuagauggaacugcaggcccauuuagucacuaccuuuauccuuguugguacugaaugguggcccagcagcaggcugaggcugagcugacaggugccucccuguguggaaguagugcuguccuuguuuguugcuuuuaccaacauuuuuguuuuuaucaaauauuuuacguaggguaacuaaaaaucuguguuauugugugagcuccacaauagcuucugguaaguuuuugauggcauuuuucuccacaagcuucaccuggauuaaggcaggaagaagcagucauuuucauuuaaauuagcaacgggaagaauuacucuuuuacaaaauaccaguauaaucuuugaaacauugcugggugugauggcaggagccagagaucccgguuggagacaggaccggcucugauuguaugccauuuaacccaggauggagcucaaaaaacaauuugcuauugguuuuguuauuuuuucucauugaccuggaacucuuaaagauccacuugcccuuccuucuaguauuaaagguaugugccaucaugcuccaaaauguguaucuuagguugucuuugguaaguuaagucagucgacuuaccuagaaacuuccuuuuagauacuaggacuguacaugccuccuguguggggucuguuguucuuccaugaauaaugccugcagaaccuguauguagccuuaccuguugagagacuucagugucagcccuuguguugucuucuaggguuuuguugggguguguguguguguguguguguguguguguguguguguguguugaaacagggucuugauaaguagcucuggccagccuggaacucuaaagagguuugacccugccugaauugccguuuccugucagagaagcacagaguagggaggcggugaauuucuagguauccucucugacugccagcccguccacacaagcaucucuaguaauuccuuuaauagauggcaaaaaggucucaaggaaaaucugauaccauuuacuguuugagaaaaauacucuuggaguuuucugguaugucccauauuucaaaaacaaaauaguuuuuccuuagcgcacacagaauuucuuggaggugugggugguuaaucaauuuggcuuugagguaauccacuuagggcagaauuuuuuuuucuucuguucacuuuuguuuuuaaaacgaccaauguuuuuguuaguuucugacauuugaaguguucuuugacaucucuggcuggagauccuuugccauaguccuuuggacuacauccugcagcacccacucucuaggguuucccucugucagcauuuacccauuucucuaguuucuugucaugggucuuagacugauuuggcgucaguacaaagggucucugccuacuugacacacagagguucgucauacuuagaagcauacagagaugggcuuggcuccccuaaggcuucgcuaguguuaauuccacaggcugggcuguucccgugaagcacuguuaaugcgcaucaccccucagacacaagugccuucucaggcccuggcaguggacuacugcagagccgagucgagaaagcacccaagccuccaagagacgcuguguacaaaggaagaacucuguuucugaaacaugacacauguaacccaagcuguccucacaccugugaccccgacuguccucacaacaugccaccuucaggcuguucucacacuugggcuccuucugggcacaugaguccuagaauuaggaacuacacuaggcugaauucuguuuucuacuucuaagcaugcagacguauuuuuaguuuucuaagaaggauuuaguuuucaaaaugguauucuugaguacuugggagauagaggcaggcaggccucuguagguuccaggacaaccagggcuacacagagagacaguuuuuuaaaaaaugugaacaguagauuacaguauuaugcguuguaaagugaaaucuaucacuuugguuuuaaagcuggguugccuuguuuauugugaccaagcauucuuguuuucagcgacacagacuaucaagcuagaguagucauaggggaccagaagcagagggcuucugucuguguggcaucauggucuaaucuacaugcuuuucuguagaguauucuagacgaugagauaucguugaucccaccuggggagacagggauccccggagcucauuugugcuccagagucaguaagacugucucagauuagguggucagcaauauucgaacacaaagaaauacagaauaaaaacuuguaaguuagugcagagauaguugaacagaaauuguggcaauuguggcaguggugggugaaggaaagguucgggcugaagcacuuuaccuaagguucaacaucucaaccucucgaagugggacccauggcauacaccagucaggcacacuuggcuaagcuguuucugccccugugcugggaguauagaagaggccuugugguugggguggcaucucugcagggucccaguggguuguaaugccucucgcuucugucugcagagauccugaaggagcuggacgacuacuaugagaaguucaaacgggagacagacggcacccagaagcgccggguacugcacugcauccagagggcccugauccgcagccaggagcuaggcgaugagaagauccagaucgugagucagaugguggagcugguggagaaccgcagcagacagguggacagucacguggagcucuucgaagcacaccaggacaucagugacggcacugguggcagcggcaaggcgggccaggacaagucgaagagugaggccaucacacaggcagauaagccgaauaacaagcgguccaggaggcagcgaaacaaugagaaucgagagaacgcgucgaauaaucacgaccaugaugacaucaccucaggaacgcccaaggagaagaaagcaaaaaccucaaagaagaagaaacgcuccaaggccaaagcagagagggaagcgucuccugccgaccuucccaucgaccccaacgagcccacguacugucugugcaaccaggucuccuacggggagaugaucggcugugacaacgacgaaugccccaucgagugguuccacuucuccugcguggggcucaaccauaaaccaaagggcaagugguacugccccaagugccguggggagagcgagaagaccauggacaaagcccuggagaaguccaagaaagagagggcuuacaacagguagugaguggacacucacccguggucagugacacagccaccaguguguuuaugguaucgcugccuucguggaaguccgagggcagucagaugaguauuuuagagaauguuagccgugccuccucuccucggauggcggagacagccugcgucuucaugguguaccuuguucccagacugggucugcagagccgcaauuuagaaacuacaaauacagguucgaauuaaccaugucagcgagugucagacugauuuuggggguuggggagugacuuggaaguaagcuaacagcuguauaaagaagagauuucauuuggcuguuuugacaaaaauguuacgguuuacaaaaaaaaaaaaaaauuagccagguugcugaaguacaacaagcgugcuucuugcuaccauaauguauauccacacgacaaguugguggucuaaagucuaaauauuauuauuuuuuaaagagguaaauggguaaauuuuacaugacauauuuuauacauggccuauucccuaacuggccauuuuuaaugacuggguacauuuuuaauaggucagacacaagugguccaggcaguggguccgagucuugccuuugcuacccuaggucaugguguagccaccuuuaacuuauaugaaguguauaaauguacaucuugccccugcuguaucauaaccggaagugcagccuggugcuguuaugaagccaaggugugcauccugcugcgugugugagcuguauagauguugcgucaagaaauaaaugaaacuuggccaguuuguuucuuuagcauuuaauuuuaacauacaaauaauuuuaaauuuuugucuuaaaaauuuauacaccagcaguuuagacaaagccuuaagcaaauuguauauuauugaucucacguaauaaggaaguaggcauuauguccaugccagcaaauacaugucaaagguguuuagaucagagguuaggacgugacugugcuugugagguccagccccaccaucuguuuuuguauggccugugagcuaagaauggucucuauguuucugagugguuuuuaaaaucacauuucaugauacacgaaaguccuaugaaaugaagauuugcgugucuauaaauaaagacucauuggaacacc

SEQ ID NO: 12411 - RNA, 7186 nt, Mus musculus
gguguuccaaugagucuuuauuuauagacacgcaaaucuucauuucauaggacuuucguguaucaugaaaugugauuuuaaaaaccacucagaaacauagagaccauucuuagcucacaggccauacaaaaacagaugguggggcuggaccucacaagcacagucacguccuaaccucugaucuaaacaccuuugacauguauuugcuggcauggacauaaugccuacuuccuuauuacgugagaucaauaauauacaauuugcuuaaggcuuugucuaaacugcugguguauaaauuuuuaagacaaaaauuuaaaauuauuuguauguuaaaauuaaaugcuaaagaaacaaacuggccaaguuucauuuauuucuugacgcaacaucuauacagcucacacacgcagcaggaugcacaccuuggcuucauaacagcaccaggcugcacuuccgguuaugauacagcaggggcaagauguacauuuauacacuucauauaaguuaaagguggcuacaccaugaccuaggguagcaaaggcaagacucggacccacugccuggaccacuugugucugaccuauuaaaaauguacccagucauuaaaaauggccaguuagggaauaggccauguauaaaauaugucauguaaaauuuacccauuuaccucuuuaaaaaauaauaauauuuagacuuuagaccaccaacuugucguguggauauacauuaugguagcaagaagcacgcuuguuguacuucagcaaccuggcuaauuuuuuuuuuuuuuuguaaaccguaacauuuuugucaaaacagccaaaugaaaucucuucuuuauacagcuguuagcuuacuuccaagucacuccccaacccccaaaaucagucugacacucgcugacaugguuaauucgaaccuguauuuguaguuucuaaauugcggcucugcagacccagucugggaacaagguacaccaugaagacgcaggcugucuccgccauccgaggagaggaggcacggcuaacauucucuaaaauacucaucugacugcccucggacuuccacgaaggcagcgauaccauaaacacacugguggcugugucacugaccacgggugaguguccacucacuaccuguuguaagcccucucuuucuuggacuucuccagggcuuuguccauggucuucucgcucuccccacggcacuuggggcaguaccacuugcccuuugguuuaugguugagccccacgcaggagaaguggaaccacucgauggggcauucgucguugucacagccgaucaucuccccguaggagaccugguugcacagacaguacgugggcucguuggggucgaugggaaggucggcaggagacgcuucccucucugcuuuggccuuggagcguuucuucuucuuugagguuuuugcuuucuucuccuugggcguuccugaggugaugucaucauggucgugauuauucgacgcguucucucgauucucauuguuucgcugccuccuggaccgcuuguuauucggcuuaucugccugugugauggccucacucuucgacuuguccuggcccgccuugccgcugccaccagugccgucacugauguccuggugugcuucgaagagcuccacgugacuguccaccugucugcugcgguucuccaccagcuccaccaucugacucacgaucuggaucuucucaucgccuagcuccuggcugcggaucagggcccucuggaugcagugcaguacccggcgcuucugggugccgucugucucccguuugaacuucucauaguagucguccagcuccuucaggaucucugcagacagaagcgagaggcauuacaacccacugggacccugcagagaugccaccccaaccacaaggccucuucuauacucccagcacaggggcagaaacagcuuagccaagugugccugacugguguaugccaugggucccacuucgagagguugagauguugaaccuuagguaaagugcuucagcccgaaccuuuccuucacccaccacugccacaauugccacaauuucuguucaacuaucucugcacuaacuuacaaguuuuuauucuguauuucuuuguguucgaauauugcugaccaccuaaucugagacagucuuacugacucuggagcacaaaugagcuccggggaucccugucuccccaggugggaucaacgauaucucaucgucuagaauacucuacagaaaagcauguagauuagaccaugaugccacacagacagaagcccucugcuucugguccccuaugacuacucuagcuugauagucugugucgcugaaaacaagaaugcuuggucacaauaaacaaggcaacccagcuuuaaaaccaaagugauagauuucacuuuacaacgcauaauacuguaaucuacuguucacauuuuuuaaaaaacugucucucuguguagcccugguuguccuggaaccuacagaggccugccugccucuaucucccaaguacucaagaauaccauuuugaaaacuaaauccuucuuagaaaacuaaaaauacgucugcaugcuuagaaguagaaaacagaauucagccuaguguaguuccuaauucuaggacucaugugcccagaaggagcccaagugugagaacagccugaagguggcauguugugaggacagucggggucacaggugugaggacagcuuggguuacaugugucauguuucagaaacagaguucuuccuuuguacacagcgucucuuggaggcuugggugcuuucucgacucggcucugcaguaguccacugccagggccugagaaggcacuugugucugaggggugaugcgcauuaacagugcuucacgggaacagcccagccuguggaauuaacacuagcgaagccuuaggggagccaagcccaucucuguaugcuucuaaguaugacgaaccucugugugucaaguaggcagagacccuuuguacugacgccaaaucagucuaagacccaugacaagaaacuagagaaauggguaaaugcugacagagggaaacccuagagagugggugcugcaggauguaguccaaaggacuauggcaaaggaucuccagccagagaugucaaagaacacuucaaaugucagaaacuaacaaaaacauuggucguuuuaaaaacaaaagugaacagaagaaaaaaaaauucugcccuaaguggauuaccucaaagccaaauugauuaaccacccacaccuccaagaaauucugugugcgcuaaggaaaaacuauuuuguuuuugaaauaugggacauaccagaaaacuccaagaguauuuuucucaaacaguaaaugguaucagauuuuccuugagaccuuuuugccaucuauuaaaggaauuacuagagaugcuuguguggacgggcuggcagucagagaggauaccuagaaauucaccgccucccuacucugugcuucucugacaggaaacggcaauucaggcagggucaaaccucuuuagaguuccaggcuggccagagcuacuuaucaagacccuguuucaacacacacacacacacacacacacacacacacacacacacaccccaacaaaacccuagaagacaacacaagggcugacacugaagucucucaacagguaaggcuacauacagguucugcaggcauuauucauggaagaacaacagaccccacacaggaggcauguacaguccuaguaucuaaaaggaaguuucuagguaagucgacugacuuaacuuaccaaagacaaccuaagauacacauuuuggagcaugauggcacauaccuuuaauacuagaaggaagggcaaguggaucuuuaagaguuccaggucaaugagaaaaaauaacaaaaccaauagcaaauuguuuuuugagcuccauccuggguuaaauggcauacaaucagagccgguccugucuccaaccgggaucucuggcuccugccaucacacccagcaauguuucaaagauuauacugguauuuuguaaaagaguaauucuucccguugcuaauuuaaaugaaaaugacugcuucuuccugccuuaauccaggugaagcuuguggagaaaaaugccaucaaaaacuuaccagaagcuauuguggagcucacacaauaacacagauuuuuaguuacccuacguaaaauauuugauaaaaacaaaaauguugguaaaagcaacaaacaaggacagcacuacuuccacacagggaggcaccugucagcucagccucagccugcugcugggccaccauucaguaccaacaaggauaaagguagugacuaaaugggccugcaguuccaucuaaucuguccaauuacuuuaagccacuuuaacuuuauauaagguugcgcuuaagaaagaggcauugcuuccuggggguauuuucuauaauauuugaaaaguaauucaagcaacaaacuccauuuacaacaaccaaaacauagacccuccuuucgaacucuucuacaucugaagcacuaaggcggccgucaaaaacucggucugccaacaguaguucugagcaaggacuugaauauucuagagccauucggacacacgagcccgcaggaggacagcacgggacacacagacccgcagucccgacagaggcacucccgcucauucaagccuaccggaaacgcgacaagcgaucagaggcucccgcggggagccagagcagagaagguaagcgcagcauccucccggaggccaccgccgccauagccucgcagccggaaaguggccgcgauccacuccagccuacgagacucaggaagcgcgccccgcccugccccgccccgcccgaagccuaugugagucgacgacgcugagggcggagaccaggagguacaccaaucagcgcgcagagccagcgacgguggcccgccccagcagcgacaggagccaacccaaggccagaggacgggcgacccgaagacauucaaaucaacucaccuccucucuccgcccggcccucuaccagaggaaaaaaaaaaaaaaaaaagcagacagcggaaacacagacuggagcgagucccgagcaaagcccgcccccauacugcccgccccccaaugacucuguagcacaaugauaaggacauuccacgggggauguugcgaccaaucaaagggccgcagaggcggaacguuccgcaauaugcuaaugauucuccuauaaaccgagcugcgaagcugcaucucggauagagcgcgcaggggcgcuuuccccagcaagucucuguaugcagugcugggcaguggcccuccaccacccccaacucuuccguuucccugcugcgcaguucuguaaacaagaguaaacuccgagcggccauccacguucaaaacagagcccccugaccucacagcaaaguuuccccaacagccaacaguucccggcgggcacgcaggcuccgccucuucgccacucugggcagcccgggucuucgggugggcugcaggucccucaccugccccgcuccucuccagccagagcccagcucgcguccaccgaucgcagcgcagucguacaccuagucggcugcgauccucccuuucacccucuuccuccccaagacacaccgcgccggcgccccucgcagucggcccggagcccuguccagagccaagagagggcccaggagagcagggccugggcgaucgcgcgaccccgagucaggacugcccaguacuuuauguaacacuuagaaccagaaccuggcgggaggcggcgacucuccggacccgcacucagcuccgccggaguacggcccgcagcccucucucuagcccggugcccgcgcccuacggccgcggcgcccgcauagcacuccaccucgcgcggccgccuucacccccuccccgaggacgcggccgagccccgcgcccccucccccgcagcaccgccucaucacuucacuacaaagagcgcuuuggucgcgcagccuugcagccagccguucgcgcuccuuccuucuccaugucccggagcucgguacacaaggaccucggcguaucaaaggcgcuccagaccuuuuguuccuagcccuccgaggacgcuaccgggcgcuccggcuccagcaggaccggucagccucgccgccgggacccagggauggacgcggccgcccccgcccauccaucacccgccguaccuugguauuuggcgucgaucucccgcaucagcgagacguuccucugcaggucgaaaggcagugacucgauugaguccagguaauccuccacauaguucaccagguggaucugcuccccguuggcaggacucaacaugguucaccccggagguccccggcgauucggcggcuuuccgcuuccuccaccccccgccccccucaaacagcacugcaaaaugcaaagcucucucgcccuuccgcgcccccccgccgcuccggccgggcuggccggcggcuacaucuggcgccugccgcgccgccuccggggccgcggggaccccggcgccugcaggcgcgggccgcggcggccgaagcucaagcgcacaccccgccggccgugcaggcccccucccgggcggcgggcggcgcggggggccgugcguacuagcgcgcacacacccaaagagggccggccaccgccgcccacccgccaccagcguggagagcggagagagcggggccggcugcgggaagggcgcgcuccgccgcccgccucgccgcacuuguccaacguggaaaacccaaauaccaguuucaaacacuugggaaacauucagccccgcgcgcagcgcgcaugcgccccgccaccccuccucccggaggcggccccgcccccaccgcauucacgccccucaccgucccgggccggggggcggcgggccgcgaggccggcccgcgcgggggcguggccugucauugucgcugggggccagggucgccgaggggacagcggcggggucgccugggcaggggagaccggcgacgcgaaacuuuacuaggaguuugacacucgguggcggaccuacugggcggagccgcacgccggccgggaaccgcggggugcuagccugcuccucgagacacgccggggccggacgagccuccagaucgcugccuucaaaccgacuaaccugagaagagccacccuccgcuggguuaacu

SEQ ID NO: 12412 - RNA, 208017 nt, Mus musculus
aagacccagagggcccgcggacgcugcagcagucccgcucgcgcuccagggugcagggcugaggcagggcccacggguggguccccuccccggucaccgagcgcugcgcaacgaggacgagcgaacccugcggggacaagcgaccgcggcgcugaccugcgcccugaagccgcggugcggcgggcugacuccugccaggucgccggagagcuucagggccgcccgugagcgaucaggucucggcugucgugugucacugagccgggcgcucucggcgagggaagggaacccggagcccuugcgcacacacacacacaccccuaagccugacgcggcgagcccagggggcacggccugcgcaugcgcaccccucugccuuccugccggcgcacgcucggucccgcagcuucaagcuggucgggucauggaggccucgggaggcguugggggcgccuuucugaaaggugaggagacacgcccaguagggagggggcuggggucuaggcucccagcgccugguugucuugccugggccgccgggaucggcucccaggccaggucccaucccaucucagggcucccuacgcccgagguccucucacauccuagguucccucacacccggaguccccucacucaggaucccgaccaccuguguggacaccccacauacauucacccugugaccuucaucgaccccuauguguuccccaauccccccaccccaccccggugcaggcugagcccuggagagcuggcgggaggauaggcuccugucuuagcuuucugggauccucuugccucuauggccucugcaguugugggaucaggaaaaguaagaauuugguaauagugugauggccucuggaggguccuaccugaguagagcugccugacacuuguggagcucaccuuuuuuuuuguuguuguuguauuuuugucgugcuaacacgugcucagaacaugggacccugggugaggagauuccaaguauaaauauauuuuauauauuuauauauuauauuuauuauagcuauguguuuauuauauuuauaucauauauguguauauauauuuaaauuuuuauuuauuauuuuagaaagcaaguuugccuccaacuugcuauguagcugaggcugacuuaucucuguuuuuuaauuugguuuggggguguggggugggggugugggcuugcuuguguaacaaaguuucucuuguggcucuagccuuccuggaccuggaaacucugucucagucuguagaccaggcugaccucagagaucugccuaccucugccucucaaauacugguuuuaaagggauacaccaccaccacaugcuuuggcguagaacucuugccucuacuuuauaaucacuaugugcuaagauacccaacuucauauaaauaauuuauuagaacugaacuguauuagcuugacuaugcuauggccauagaaucguguuauuggaagauagucugggccagaaagccuggaaugauuacuauaucuguuucuuuacagaaagcauaauccaggauaauuauaaaucuuccuggaugaggaagauuuaaaauacuaccaaaauggcaaggaugauguuuugaauagauucguaauaagaaaucuucacguaauaggaaacuuucacuuuuuuuucccuaaaauaaacagaacaagagaagaaucuauugugggagggggugugcaauuccuagugugugguuccugcuaagaucuugcuuauuuucagauguuguggccuauguugaaguauggucuuccaaagggacagagaauuacucaaggacguuugcaaagcaacuugaggauaugggggcaacgguaagaaauuaauaucaaaaugacugauaaccugguguuuucucguuaugggagcuguuccuuagaacacgaaggacuuagcagugggugagugguaggaggcagaacaaaccaaccaaauacaaguuggacagcagugcuuacagaggagauagucuuggaggcauuguguuaggaggagucuagugggagacuugagucuggcauugguucagugagggcugguacucgcaguggagagaguaaagaugcaggagaaugagcagguuuccaagggaagauugugaccguaggcauauuggaaacaucucauaggcauuugauuacucaugucuggagcuugaggcagucagaucuguagacugaugugggggucagcagaggauggaaccuuacucagauccugaggaguccuaaaggaggaggaggaggaguguuuaaggaccagugauggccugaccaccaaccugggaacaagaaagggaaaaaaaauugucaggagaauaucaaaagcaaguaugaaagaauuuaagagguguggauucagaacagcagagccuuaaggaacgguaagaugugcuuaaggcuugucaguuaugaggcgauugcucuagcucacuuucuuuuuaaaggacaaaaggguucaaggugagucugagauuccugacuuaggaagaaauggagauaguaaacucagacugcucugauaggaagcuauacuggcuugacacaagcuggagucaucacagagaaaggaguuuugggugaggaaaugccuccuugagauccagcugugaacggaaguccaaggaucuaccaguguucagucccacaagacaagcagacaaagagagugaaucuuccuucuuccaaugaccuuaccuaggucuccagcagaagguguggcccagauuaaaggugugugccaccaagccuuuaaucccagaugaccuugaacucagagaucucccuguuuuaaucuggaauucauaagccacuaugccucaagaucuccaugccaagauccaggucagaaacuuguaucucccagccuccagauuagcaucacuggugagccuuccaguucuggauauaaucagguugacaagcaggaagccaccgcagacccuuugcuugcuuacugccauuugugagacucccugacaggcugaguggaugagcgagagacaggauaacuccucacgucaggguggggauuagggugcaguaaggugguauuagggcagugcuggccuccucaaaaugaaacaguccgaaguaaaacugugguaagacagggacuuuguguauacacaugccuuuguauacacaaaggcauguguauacagcaugccuuguuacacaagcauguggcacaccaauuggaguucgggagggccaacguauaggucaugccucugucuagacgcaguuuguggcagcucagucccaagugugggauuuuaucacauccucaccuaaggcuucuaguaaguaucccacaccauugugaaagacaucuccaggugccgcuuguugucugguaacuuugcugaacaccuuggggagaauguccccggugcgcagcugggcucuuuucuggugucuugagaaaaccaguuuacaaaaguaacaccugcgcaugccugaaacaggugcucuacagggcuuugaaaccuguaaugaaacaugagagaaaccaguucacaucugcuuuauaccccuuuggugcagagauaugauuccaggccucacacacacuuagacaaguacgcuaucacuaaacuagauucccggacucuucuguuuuugaaaggcaauuuaaaaaccguggguggagagccagagaaccauggcuuguauguggaggucagaagacaaccugagccaucuccuaccaugcugggucuugacuguuuugaauugucugaucuuaccacaugccuuaauuaggguuucaucgcuaugaauaaacacuauaacuaaggcaacuguuauaaagacaagcauuuaauugggguugacuuucaguuucagagguucaguccauuaucaucauggugggaagcaucaugcaggcagacuugguacuggaggagccaagaguucaacauccuuuuuuuuuuuuuuuaaauuuuuuaaaaaucuuuuuauuauauauuuucuuuauuuacauuucaaauguuauccccuuucuuaguuuucccuccgaaaauccccaucccuuucccccucccccugcuccucaacccacccacucccauuccugguccuggcauuuuccuauucugaggcauagagccuucauagagaccuagggccucuccucccauugaugaccaacuaggccauccucugcuacauauacagcuaaagccacaaguuccacaauguguuuucuuugauugguggguuaguuccaaggagcucugggaguacugguuaguucauauuguuguuccuccuauggggcuucagaccccuucagcuccuuggauacuuuuucuagcuccuucauuggagaccuugugcuccauccaaggaaugauugugagcauccacuucuguauuugccaggcacuggcagaguacaucaggagacagguauauugggcuccuaucaguaagcucuuguuggcaucugccauagugucuggguuugguugucguuuaugggaugaauccccaaguggggcaguaucuggaugguuguuccuucagucucugcuccaaacuuuguaacuccuuccauggguauuccccccccccccuccccgccccgucuaagaaggauucugagcuucugggcucagaaucagugagugcauaucauguguguucuuuugugacuggguuuccucacucaggaugauauccuccagauccauccauuugucuaagaauuucauaaauucauugucuuuaauagcuacguaguacuccauuguguaaauguaccacauuuucuauaucuaucccucugaugagggacaucuggguucuuugcagcuucuggcuauuauaaauaagacugcuaugaacguaguggaacauguauccuuauuacauguuggagcaucuauuggguauauguccaggagugguauugcuggaucuucagguagagcuauguccaauuuucugaggaaccgcuaaaaugauuuccagaaugguuguaccagcuugaaaucccaccagcaauggaggaguguuccucuuucuccacauccucaccagcaucugcugucaccugaguuuuugaucucagucauucugguuggagugagguggaaucucaggguuuuuuuugauuugcauuuccugaugauuaaggauguuuaacauuuuuuuaaguucuucucagccauucaguauuccucgguugagaauucuuuguuuagcucuguaccccauuuuuuaauaggguuguuugguuuucugcaguccaacuuguugaguucuuuauauauauuggauauuacccucauaucggauuuaggauugguaaagaucuuuucccaaucuguugguuuccuuuuggucuuauugacagugcccuuugccuuacagaagcuuugcaauuuuaugagguuccauuugucaauucuuuuguuuuguuuuguuuuuuuuuuugguuuugguuuuuguuuuuugagacaggguuucucuguauagcccuggcugaccuggaacucacuuuguagaccaggcuggccucgaacucggaaauccgccugccucugccucccgagugcugggauuaaaggcgugcgccaccacaccugguuacgguucuugaucuuacagcacaagccauugcuguucuguucaggaaucuuuccccugugcccuuaucuucaaggcucuaccccacuuucuccucuauaagcuucagugucucugguuuuauguggaguucuuugauccacuuagacuugagcuuuguacaaggacauaagaaugaaucaauucgcauucuucuacaugcuaacugccaguugagcaugcuguugaagaugcugucuucuuuccacuggaugguuuuagcuccuuugucaaagaucaagugaccauagguauguggauucauuuuugggucuucaauucuguuccauugaucugucugucacuguaccaguaccaugcaguuuuuaucacaauugcucuguaguaaaacuuuagguuaggcauggugauuccaccagggguucuuuuauuguugagaauaguuuuugcuauccuuggauauuuguuauuccagaugaauuugcccuuucaaaauugcccuuucgaacucgguuaagaauugaguuggaauuuugaugggaauugcauuaaaucuggagauugcuuuccgcaagauggccauuuugacuauauuaauccuuccaauccaugagaauggaagaucuuuccaucuucugagaucuuggauuucuuucuucagagacuugaucauacagaucuuucacauccuuaguuagagucacuccaagguauuuuauauuauuugugacuauugugaaggguguuguuucccuaauuucuuucuuagccuguuuauccuuuguguagagaaaggccacugauuuguuugaguuaauuuuauauccagcuacugcacugaagcuguuuaucagguuuaggaguucucuggugaaauuuuuggggucacuuauauauacuaucauauuaucugcaaaaagugauauuuugacuuccuccuuuccaauuuguauccccuugaucuccuuuuguuaacuaauugcucuggcuaggacuuuaaguacuauauugaauagguagggagagagugggcaggcagccuugucuugucccugauuuuagugggauugcuucaaguuucucaccauuuacuuugauauuggcuacugguuugcuguagauugcuuuuaucauguuuaggcaugggccuugaauuccugaccuuuccaagaaagacuuuuaucaugaauggguguuggacuuuaucgaaugcuuucucaucaucuaaugagaugaucaugugguuuuugucuuugaguuuguuuauauaauggauuaugucgauggauuuccguauauugaaccauccuugcauccaugggaugaggccuacuugaucaugaugaaugauuguuuugauguguucuuggauuugguuugugggaauuuuauuaaguauuuuugcgucaauguucauaagggaaauuggucugaaguucucuuugcugguucuuugcgugguuuagguaucagaguaauuguggcuucauagaacgaauuggguagaguaccuucuguuucuauuuuguggaauaauuuaaggaguauuggaauuagaacuucuuugaaggccugauagaacucugcacuaaaccaaucugguccugggccuuuugguuggaagacucuuaaugauuguuucuauuucuuuaggggauaugggacuguuuggaugauuaaucugauccuaauuuaacuuugguaccuuguaucugucuaguaaguuguccauuucauccagguuuuccaguuuuguugaguauaggcuuuuguaguaggaucugaugauuuuuuuuuuuggauuuccucagauucuguuguuacaucucccuuuuuauuucugauuuuguuaauuagaauacugucccugugcccucuaguuagucuggcuaaggguuuaucuaucuaguugauuuucucaaagaaccagcuccugguuugguugauucuuuguauaguucuuuucguuuccacuugguugauuucaccccugaguuugauuauuuccugccaucuacuccucuugggugaauuugcuuccuuuuguucuagagcuuuuagguguguuguuaagcugcuaguguauguucuccccaguuucuuuuuggaggcacucagagcuaugaguuuuccucuuaggacugcuuucauuguguuacauaaguuuggguaugguguggcuucauuuuuauuaaacuuuuaagaagucuucaauuucuuuauuucuuccuagaucaaguuaucauugauuagaguauuguucagcuuccacguguauguggacuuucuauuauuuauguuguuauugaauaucagccuuagucuguggugaucugauagggugcaugggauuauuucaaucuucuuuuaucuguugaggccuauucgguaaccgauuauauggucaguuuuggacaagguaccaugaggugcugagaagaagguauauccuuuuguuuuaggaugaaauguucuauagguaucuguuaaauccauuuguuucauaaguucuguugguuucacugugucucuguuuaguuuuuguuuccaggaucuguccuggaaaguggguuguugaagucucucacuauuuauuguaugagcuguaauguguacuuugaguuuuagcaaaguuucuuuaaugaauguggaugccuuugcauuuggagcacagauguucagaauugagaguucaucuugguaaauuuuaccuuugaugagucagaagugucccuccuuaucuuucuuugagaacuuuagguugaacguugauuuuuauucgauauuagaauggcuacuccagcuuguuucuucggaccauuuguuuggaaaauuguuuuccagccuuuuacucuaagguagugucugucuuugucccugagguggguuuccuguauguagcaaaaaguuggguccuguuuauguaaccagucuguuagucuauaucuuuuuauuggguaauugaguccauugaugauaagagauauuaaagaauagugauuauugcuuccuguuauuuuugauguuauuuuuauguuuguguggcuaucuucuuuuggguuuauugagagaagauuacuuucuugcuuuuucuaggggguaguuucccucauuguguuggugauuucuaucuauuauccuuuguaaggcuggauuuguggaaaauuauuguauaaaucugguuuugucauggaacaucuugguuucuccaucucuguuaauugagaguuuugcuggguauaguagccugggcuggcauuuguguucucuuagggucuguaugacaucugcccaggaucuucuggcuuucauagucucuggagagaagucugguguaauucugauaggucugccuuuauauguuacuugaccuuuuccuuuuacugcuuuuaauauucuuucuuuguuuagugcguuagguguuuugauuauuaugugaccagaggaauuucuuuucugguccaaaccauuuggaguucugugggcuucuucuaugcucgugggcaucucuuucuuuagguuagggaaguuuucuucuauaauuuuuuugaagauauuuacugacccuuuaaauuggaaauuguccuucucaucuauaccuauuauccuuagguuugguuuucucauuguguccuggauuuccuggauguuuuggguuaggaucuuuuugcauuucacauuuucuuugacuguuguguccauguuuucuaugguaucuucuguaccugagauucucucuucuaucucuuguauucuguugguuaugugugcaucaauggcuccugacuucuuuccuagguuuucuauuuccagaguggugucccuuugugauuucuuuauuguuucuacuuccauuuuuagauccuagaugguuuuguucaauucuuucaccuguuuggaugaguuuucuugcauuucuuuaagggaguuauuuauuucuuuuucuuuuucuuuuucuuucuuucuuuuuuuugagacaagguuucucuguguagcccuggcuguucuggaacucacucuguagaccaggcuggccucaaacucggaaauccaccugccucugccucccaagugcugggaucaaaggcgugcgccaccacugcccggcuauuuauuuccuucuuauauuccuccaucucaucaugagaagugacuuuagauccauaucuugcuuuucgugugugaugguuuauccagcgcuugcuauggugggagaguucaguucugaugaugccaaguguauuggcuaguuuugugucaauuugacacagcuggaguuaucacagagaaaggagcuucaguugaggaaaugccuccaugaaauacaacuguuagguauuuucucaauuagugaucaagauggucccuugugggugggaccaucucugagcugguagucuugguucuauaagagagcaggcugagcaagccaggggaagcaagccaguaaagaacaucccuccauggccucugcaucaacuccugcucccugaccugcuugaguuccaguccugacuucuuucugugaugaagagcaauguggaaauguaagcugaacaaacccuuuccuccccaacuugcuucuuggucaugacguuuuguccaggaauagaaagccugacuaagauaccaaguaaccuugguuuuuguugcuucuguucuuaugcuugccuccugucaucugauuaucucaagugcucgaugcccucaauauaucugauuggagccuguccuucuuguaauccugcuugagucaauauuucugauuggagccuguccuuccucuaaucccaguugaguuagaacuucucagaguccagcuuucucuguaauccugugauuccaggauuaugugaacuugaaauuuuggguuugucagaguaguuggcagucaagcuuccucugagacccugagauccugaugugaccaagcuccugggguccugggaucuuagaauccuaagauucugggaguguuagagcaccuggaagugguaccuucucuggggaccuuggggcuuuccacuguguucaaaaccaagguagaccagcgcuggcugaccagaaggaacccgaguugaugauagggcagggcuccugugucccugcuccugcuggccccaggcacucccaguuguauuagaacagauguuguguuccacucaccagugaucauaugauccugggcauguuagggugccuggugcauggagagucuucugaggaccguggaaccaacugcccaguucauacccaagguggccuggagcccaagaguucuacaucuugacccuuaggcaacuaggaggagugucuggaucacacuggucaaacaugagcauauauaugagaccucaaagaccugcuuccacagugacacacuuccucuaacaaaacuaugccuccuccaguaaggucacaccuccuaauagugccuuuccuauggcccaagcauucaaauacaggagucuaugagggccaaaccuauucagaccaccacaucacauaaacaugucaugucaaaauacuguuuuuaacuguaauuagauauguguucucuuugauguuucuuuccuuugaauuauauugucucuuuuuaauguagaggguuauuuauuuacuuaaugagacagggucucauguacucaaccuggucuagagcuggcuguguacaagaagauagccuugaauguaugauccuccuguucuuaccaaaggacuaagauuacagguacuuacaaccauuccuaguuuuuuuauggugcugagaauaaagcccagugcuuugugugugcuaggcaaacagucuaccaacugagcuauggccacaacccaacauaagaaguuuaaaaaaauuguuuuuaagguuuuauuuauucuuaugaguuuucaucuguaaauagguaguagcuccuccugucaguuccucuuugcucuccucagggugcucccccuguuugcucucuccauuucccuuugcacuggaagaaccccgacucaguucuaugcuuggcagcuuuguuguggggagcaaaggugacuggagcacaagcuuccugaggagaggggguaaggguuacaugaucacuaauccccauucuaacugcagcagcucuacuugguagggagagguugaaacaggcucucacuguguaguucuagcuguccuggaagccuccauguagaccaggcugaccucagacucaugaagguccuccugcuccugcuucccgaggacggugucuggaauuaaaguugcauaccaccacacuaugcagaagcggguguguuuuuucaagcaucuuuccacguucaccacaguauuuuucugguguauuccaagaagugaaauucuaauguaaggguuuuugaucauuucauuuugacagauuuuaaauggucaucuuuuuaauaacuuuauuuaagaaauuauggguaaauaacaguaaguauuuuguucuuuucauuuuguccacagguuucaaaaaccuugaacaagcaagugacccaugugaucuucaaagauggauaucagagcaccugggacaaagcccagaagaccggggcgaagcugguuuccguccucuggguugaaaaguaaguagucaccguggagacugugacagcacuguguaugguagcacagugcuacggaauguuguugcuguuaacaacauucaguagacuugccgugcaggaacuuauuuucucauagcuauggaaguuucuuuucauacaucauuggccugaacgugccuaugcucucuugacauucccucuguuuguguuuuuguccucauuuccccuuaaauggucaugucacuucuuaaauauccucucuccaaaugcagugacuuugagguuuggguaggucaggguacacaguguggagacuugugagggugaaguaugcccauguugagguuuguaacguugcuauguauuguaaugcuaaauucuacacugcaggucugggucuucuacgagugaauccucagguuuaccagcuucugugcaaaccuuguuccuaauaaagaugccuacagcuuauagcugagcagaagagagguacucggggcuuuggucucaaacuuggagucuugaggcaggaggaugcuugaggaacagaggagagaagagagagcaagaugccaugggcgagaacuguccauaagggcuagccagucugagucagagcagcccagguagagcagggcaaguuauaacuugggauuauuaauaggcaaguagauacuaauagcuuagagaguagauaucugcccaguucuaacgcuguuaagacuuauuauaaauauaaaaguuuuaugccuuuucuuugagaacuaaaugauccgaggcggaguaaaaaugcccaauuaauauuaauauuuaccacaaaugaauugugcuggaaacugagguuagggcggaagcucaugguggcggugagcuguuggauguucagaccagaccgggaugauagugaguaguaaugacugacuaguucaggauuuuaaaaagucaugugugcauguauauguauaauuuucuauauacauggguugcugaaaaaggcuaugguucauugucugaccuaggcuggaaacugagcccagaacuagaaagaugguuuggccauuggcuaaguuggagaaggcuuuagagaccuggggguggaagcuagaaugauacacaucagagucaggacucuacugaaaugugccaaauccuauuuuggauauuuccuuagacaaugcucaguggaggugacaggcaggugaguggguagacaaauucagggggagauuggcaaccaagauaugggagccaucuguacuggggaucuggagccuagaggauaacgagugugcuacaaagggcauggcuggacaagugacccaagcccuuggaggagcccagaagauagugaguuggaucccagacauugaacgguuggagauugauuuuugcuuuugauugugauugugcccugauauuuucccucuugaaggaagaaacuguuuuaguggagcccacaguuaagagauuuuuaauuguaaaaagacuuuggauuuuaaaagagauggauauuuuaaagagauugaaauuuuaagaauauguaaaguuacauacuagcagugagccuugguaaacagguggaggagaaauaaaguugagugcuccugggucuggaagucaggcuaagaaggaauuggguuagggcacaaagaaugaagaauuuauauuuuggaaaacacaguugaacuaucaguauucauaauauuucugaccucagaugugugugguccuguccucacugggaaagucuccagcucaguuggcacaagcaggaugacucaguugugacacugggcuuuggcucagauuccacagguaggaacucaguccuucaggucugcuuugacuugagauggcagucauaaguccaggccucugcacuuccguuccaucagcuauaaacugggcuucuauuacucccuccuugaguugaugguuuguuggaauagcucaguauucaaggaagaacuucuccccuccccuggccuuuuagggcuccuaauccuccccagguauguuagguugcuguccucacuccucuagucuggugccugucaggaacaacuaaguagaagagcugcacaggguguuggccugaagccccauacccucugcaggggcacugcuucucuggauuuauaagaugugaaggcucgucagccagccuugcuggcuuauaugggguugaaucuucagugcucacaguugggggauaugugagugggguagaaguuuuagccuugaauucucaguugauucuuugggcuagcugaauuccugccguaagucagccacuggcagaagcucaucaaaacagaccaggauaaaggauuaacacugaggaaucuuaggggagaaaagcuucauugcagaaagugugacaguggccaguuagaucucagacuauaacaugcacgucuguucuaggccacguuuaguuuuacacaggaugccucaggaaguguaacgcugacacuuccucucucagugucccguggucagccuccugcccaagacugcuacauuccugccaggcuguccaggaaccagcacucaaaugcuuucucaugccuuacuauauuauauucuucacuguuuucauuuagauuucucuuaguuuucugaaauagcaaggugacuccuuugugcugcaugauucaggaaacgcccuauuccagaguccuuuacugcucaaguuucuccuacuuuggguaguuaguuaaggagcuagaauaggggggauagauguguucuagauguuaaauacaaaucaaagaguggcucauguaaucccuguccuugggaggcuacggcaggagaaacacugugacuucuggguuagcauaagauacagaguaagaccuuguugaagaacaaacagcaaagauuauaaaaaaaaaauuuaaacaggcucuaaagagagguucucuaugguguuucugagugacuggaaguggaaguuuuagugcugggaacuucacacacgcaugguuaucucacauucagaaugcuagccaccauaaguguucucagacuuggagauaauuugcauccguuuauuagauaaucaucuaaaauguguaaagucugaaaucuaaaauggucaaauguccaguuuuaagggcugugaauguagcuugguuguggaguguuugcaugaaaccguaagcuaguacaugaaugaaccaagggugcguaugcccaccugcaggaggagcuguagguuaaguucagccuuggcugcauaggaaguacaaagccagccugcgauacacaagacccuguguguuagggcguuuguguauugguuuucuuguuagcccugucucaaaguggagaaguaaagagaagaaaagaaggaguuucaggcuucagguucuuucuuucuuuuccuuccuuccuuccuuccuuccuuccuuccuuccuuccuuccucccucccucccucccucccucccucccucccucccucccuuccuuccuuccuuccuuaaaaauauuuauuuauuucuuuauuuuauguaugugaguacacuguagcuguacaguugguugugagccuucaugugguuguuggggauugaauuuuuaggaccucugcucgcuccggucaaccacacucgcuccuccggucccuguacgcucuggcccaaagauuuauuuaucauaauacauaaguacacuguagcugucuucagacacaccagaagagggcaucauauuucauuacaggugguugugagccaccaugugguuguuggaauuugaacucaggacguuuggaagagcagucagugcucuuauccacugagccaucucgccagccccagaguuucaaaauaaggcuguucaauccuaaaauauugagcuguagucauugcaugugucuaaugacucuucccaccuuuguguugauauuauauguauuauaucuacguguacccuaacuuuuacaauauacucaucauuuuuuuccauuggacaauugccucuauguuaaauauaguuagaaagugucucauucacacguguagauacagaugcuauucuuauugauauucauuccuaaagauccagguuuccuccaauauuuuucuuaauuuuucauuaaauuuuuauauucauuuauuacauauagauaucauaucauaaauauaaauauuuuguuauuuauuauuaacuguuuaaacaauuuuucacugagauaauaaaaucacaccucacuccccgccgccuccugccccuggcagcucucagucuaccuuguauaagauaggcaaguacucuaaccacagggcuacacugaagcccacuugugaaguucuucauuuguucuggugauaagaauuuuaucauauauguuauucauaaaccuuguuuuucucucuuuaugcauuuucuaaucacuuuuuuaguuguguuucuuugacauagaaacuuuuguuuuucuuuuguuucuugugcuuuaaaugucaccuuugagaaaccauugccucaucaagagcaaaagcuuucuaucucugcuuccuuuuaagggucuuguuaguuuaugugguguacuuaacucugucuauucugagugaguguuguguaugauaagagaggauucuaccuuugcuuuuuugcauauuguaagguuguugccccaacaccacuguuugaagagauugauguuuuuggagccauuguugaaaauuggcuagcauuaugggcuuauauccagacucucaauuauacuuauuuguacacagaggggauggguguguggguaugcuugccacuguuaauuugucucgcuuuuguuuuguguauugguucuucgugaauuucacaucauguaccccagucccacucaucucccgcuccucucauacccacccuccacccuugccacuuccuccccaacagagaaaaaccaaaucuuauuguggaagcgguagugugucacagcaugucccauaguacagucuauuguuugcacuucuuugcuugcaaauauucauugcaaggacuuggucuggcacgagggaggccucaggcuuuugcuacucugucaguacuggaaccucacugggacuccccuuggauacccuguuguugcccugccuuguggagaucugugguuuggaaucaguaggacuagucccuucaugcacuaguugaugagguagauguuggggcgggccaauucaaagccuugggucauggccugcccaccaguucucccacucacacgcccucaaggcuagcuuaccagcauuaccagcaacucccaucacaccagggccagcuauacgucgauguccaggugagguacaggccuaacuaucuugaguguuguagccaaugagagacauggccaguucuccucucaugaccccagggcuggcucuccuaccugccauagaugacaagggacaagggaguggaggagggcaucguccacaccacugcccagcagacaggagccuggacuggcgcuccaugccuauccccuuggggccggcucacccgcagcuacgugcagggcugugcugcccagugaggugcagggccuucuccugagugcugcgugagugagaggcagggccaacucucccgcucugaugaccuuggggucagcucucuugccugcuuuauuuggcaaggggcaucucuuccuuaccugugucaccacacugcagacaagugacagggcuagcucuucuacauguauguccuuggggucaguucucucucucucucucucucucucucucucucucucuuucucucucucucucacacacacacacacacacacacacacaccagggucagcucuacagugcugcccaggugagaugcagggcccacucuccugagugcugcggcuaaugagggacugaggcagcucuccuguucuugugaccuggggcuaggucucccaccugucucagguggugaggggcgaagcgggaaggaggguuuccucccucacccaugccaccacauggaagacagugguaagggcagcucaacugcaacgccuacaaagugaggggccaguucugcacagcccucagacauaauauaguccaaaauggcgucccagaccugggauguccaccuggcuuuaacagaccccugcugcugcugggccaaggacucagauguggccccugguggcagcacagacaaggaccccacgauggucccagagugucacuagcuacucacgucagacuguuccucacuacccucgaguuucuaguucugccucucuucauugugaccacguccuuuugcuucucuuucucuuccauuucuccacuugcuccucuuagugguggccagggucucugagugucuggagucaucucaggaguggucucaggagugcuaugccccgcuugugcaucauggcgcugggcaggauucagcucaggcaugguguguucccuaaggcccacauggcacuggacugggggucaucuuagacucauuccuuacuaggccugucaucuuugcaagggucuucagucucgggcucacucuacccuggcccacagucucuggcaccagacugauagguggucaucucagacuugcuuuuuuccagaaacguuagucugcuaaucauucagauguucacaguucagaacacugagcauagacauagccucucuccucagugccaccuacugauccacaugugacccagccacaccugcaauguuuuuagaggcaaaauaauuggcacuuuuaauuggcuuauugaguucaaguggccagauuuggcuuggggcacagguuaugacccccaaguucaggauuaaaggcauguaccauagccccacuuuaugcuguacuguguucaauccggggcucuauacauucuagguaaguauucuaccaauuaagccaucaccucugccauauaaagcauuauuuuauauuuauuaaacaucaguggaaugaggcuggagccaugacucaauguuaagggcacauguuguucuuauagaggacccagguucaauucccagcacccguaugggagcugaaaaccauccauagcuccaguuucagggggucauggccucuucuuaccucuguggguacucuacacacauggugaaccuauaugcucauacacauaaaaauaaauauguguaauaaaaauaaaauuucaaaacuuauuuuuuaaaaauaagacauaucuuuauguaaaacauguuaaauugcucuaguauuauuuaaagguguauacauguuauuuagaaguaaaaucuauauguagacauaacagaaaugcauaaagguguuuucauguuuugauaugauagguuuaguaagugguguaaaagauaaagaaaauugugugucucugagauggcucagacuguuaagauacuugacaccaagccugauggccugaaugucaugaccagaagccauuuggugguggaaagcacagaugccugcaaguuguccucagauuugcacacauguaacaugaaaugagcauacccacagagccacacacacacacacacacacacacacacacacacacacacacacacacagaaauaguaauaaaaaugaaacaagggugagguuucuccuuuaacugcuuaggguuacucaucuuuuuuuaauuggcaguggucauguguguggcaucuagggucaccagauuuccauuguguggggacucaaggcuugagacuauaagucucugauaaaaaggcccuucuuuuagagaacagaaaaauuuauaucugagaaaauaaacaaugaagacagaauaauuagccuggcucucaucucucugguuuucugaagaaaguuaaaguuuuaaaaaacuagcacaaaagcacuaaaauguaucuuuuagcuguugucagccuguuaaaggaagcuuuaagacugcugcagagauaggaccuaggccuguggaggagcauuccucaggugucaggaccugugaggagcaguccucggggucagguggcuggcaagcaggugauggcgacagaggaagccugcaguggacauucaucucuucaaaguaguuggugaccuaaguagugaucagcagcaaguauacugcuuuaagauucugccugucuacccuucuuaaagucucccugugcucuuaguuuaugcacacucugguucaugcugaucguccucuuagaagagggggcuggauuguaggugguuuaggcuuacaaaagguaaaaaagcaauuuggugucuaguguggcaugaggagaauuggugcuggcaaucuuuggguuauuauguuauuuccccaagugccuucccuuccuuuguauaguuacauggucuuuuuuagcaccuaguucaguuacagucuccuccaaaaggauucugagagcacagucuguguccugcaacaguucagucucuugagccaaccagccuggggagacuggugggcaaccagucugcuuuguucugacccucacuggguacaacgcgguguucaguaccuaaaacacaggucccaauucagauacacuugcguuuucucuguucagagauccccucaaauucuccuuccuguguucuuccauguaucucagaauauaccuguugggaucacgugcuagcccgcagaauuuucagauaugucuguccuuaccuguucaacccacucugucuaaugugauagauacaucuguguuggagaagaauacgcuugcugcuuauaugacucacugacugcuuuagagggugaagggcaacaguuugguggaggugaaggaguaacagggcuggcccagcugaggacaugggaaaugacagggguccaagugccgccucccugggcucugaaguggcuagagcugggucuguugucagggcugccuugaaacauuuuucccuuagccacuagauggggcacuaauguuaugcauuucugaacuguagaagucucucucauaggaagcaauuucuguuacucauagagugcuggauaaaugugaggcuuucugcuauuagugccguuuguuuuaucgcuguuaauuaugugucuguguggguaugugcacaugaguuacccaaggaggccagaaccaucauaucuccuuggaguuggauuuaaagcuggucgugaccugccugacauacauuccaggaauugaacucaguccucuggaaaaacauuuaacuacugagccuucucuuuagccuuggguuguuuguuuguuuuuuguugcuuuuuguuuuguuuuggggucuuuuugccuugauuuugagacaaggucucauauuauagcccgaggcaacuugcaacucgcuauacagaucauauuggccuggagcucaaagagaucuaccugccucugcuuccaacaugcugagauuagaaauguguauaaccaugccuagcucaguauaaguuuuuuuuucuuaaagauuuacuuauuuauuuuauguauaugaguucuguaucugucuucagacacaucagaagagggcaucugaucccauuacagaugguugugagccaccaugugggugcugagaauugaacucagaaccucuggaagagcaaucagugcucuuaaccacugagccaucucuacagcccucagugugagguuuuauggguacuucuuaccuguucgccugugugaacaugcaaguuccuugccuaaauauauguugcuggcaucguguuuccuuucauguggggacuaacacaauccuggaucugagccuuuguguccugucacugaucagugaauuguuaagaugcuuguuuuaaagugggacaaaaugcgucuucucuaacuaguaugaaccaaggcuuuccccaaacucuuaccuacaaaagaugauugguaauuuaaugaacuugggcugauggucugugaguuaaacaacuuuuguaacccagaaggaaggugguagugcuuacacaccagaacuggugcgggcaguccauacuaucugaccuugugcuuaugguggcugggauauucuuaacgugguaaucgggauccucagauucagucguucucuguucagaugagucccaaccaucuccuuuugcucuucaguagaacaaguugguacgaacuacucuguuaaacucguaacugugcuagaaaagaggcacauacgauacacuuaacuccugcuccuuucucaccguucucacugggcuuucuuguuuucuuucucccuuucucuccuaucaucucccaccuucucuccucucaccaucuaacuguaucucaggcuggccuucagcagucuuugugccucugccuccccaguguuggggucgucagcgcgagucagugcauccagcucuccugguaggaccauucugaagcugugggcuucuguaggcuuaaaugugggccuuucuuaaaagcagcuuuguaaaaguguggcuuaaaucaagugugguggcucaugucuguaacacuaggaucugggaggcugagacaggaggaucacagaguuuaaggccagcuuaggccuucuggcuuguuccaaacaaccugggguacgaugccagacacugucuuuaaauguccccuuugaguuuauagauugguuuguuaucucauaaucaccaaagucaaaagacugggguuuuauaugccagaguaacaccgcccgccccuuugaagucagcaccuuucuccccauccuucagccuggagcagccugugaucuggauucuguaggcaguucauuccuugauguaggauuucaggcagauggacucuucucgcauggacuguuuggcuuccuccacuugaaugauaguuuagagauuucuucauguuucaugcaguaauaguuuccuuugucuagccaaguaguauccauugcaugugcauaccacagugcauuugccagugguggaaaugugaacgguuucccauuuuugguuacuaugaaugaaguuguuauggagauuuguguuugugccuuucuguguuuucauuucucgugguuuaucacccaaacaagguggcugcaugguuuuauguuccucuagcagugugaguguucuuuuguuccaugccuucacccacacuugggauuuguccaucaucugaauuuagcaauuaagaguggauacauagcagccuuucguaaguucuaauuuacauaccauauaauuuucucaguuaaacuauacaauuuacugcuuuuaaacauacucaaagaguuguacagccaucuccacaauuuuaaaguauuuuguaccuggaguugaagccugcacccuuuagcucucacucccacgucugaagccucagcagcuguuuauucacuuccugccuuuauaguuuuccaguucuggguauuuuuguauaaaugcagcuauauaguuuggcaaugccugaagcugcuucuuagcaaaaucuguucuguugucccuuuuauuugcuuccuuuuucugaucaaauagugcuugauuguaugagaguauaugcaugagcacacaggaacacacacaacacacgcacaagcaaaaugcuuauuggacucacaauuccagguuauagcaucauggcagucaugucacugcagcagguggaugagagaauugguucuguuccauccauggucaagagcagggaacauugaauguacauguguuaauaguacucagcucugcuccucccuguuuuaugcaguccaggaucucuuucucagugaaugguuucauccaaggcaagauauucuugccuuacucuagacaguccuuuacagacaugccuaggagccugucuccugggugcugagcuguuaguucauaguaacuaucacaggguagaagguagucagcccauauauguguaccgugugcauacggugcccacagaggccagaacagugcaucauccccggaacuguacaguuacacuauagaugauuaugagucacccagugacuaauccaggucuuuugcaagagcagcacugcacuaacagccagccgucucuccagccacaggaaauuugucuuuaaccagucccccucagaguacccugcucccacaggcaacguguaugcaucuuuugcucacaaauguucuuucuuuuuauaccacuguacaagccaguggcuucugcuugcaguucugauaggaaguagguaguuggaucuuguguccaccauggauacaguuccugucacauagagcuuuuucccuuccuccugugcugccugccaucccaauguccaaagcucuuggcuucuaguuaucucacauggacauaagaauuccacccugguguuaggagaguggguguuucuaggcacccauguccagacaugcucaccugcuccucucucuugugcuccccacucccgcuggggaggaccuggaguccuugacuucugcaccucugcuaggccuggacuuccuuuuguuuguuugguugguuacuuuccaguucugcaggcagcucuuacccacuccuuguuuucauuaguuuaugucccauuuguuuucuuuuacuguuauuuuauugggaucugguggacgaagagaaaaucgugcacuuguucugucguuuaacccagaugacaaaaccuguuuuauucccuaaacauugcuuaguuauuaucucagggcccuguugugccuacucuguuacugucaaucuucaguggucccuuggguacucucuugcuccugaaaccuauuguuugggugaccuauuugugacacuuccuucaauaccucuuuccuuagauagaaccugcaggggcaggaggucagcucuuaagcauagcaaaauguccgcagggagaccagaacucugugugauggucucucauaacugggguugucugccugaucuuucucaaagcauuggugguauguaggaaaguuacuuauuugguuuuuauguugauuuuguaucugucacuuugcuaacauguuuaucagggcauuuaugcuggaggcuuuaugguuccuuaauagauaauaucuucuagaaauaagaacacugacuucuuccuaugcuacuuguauucuuuuuauuuaccucucuugucuuauuguucuuucuaaaaguccauuccucuuuuaagguagggucucauuacguaacucuggcugaccuggaacuugcucuguagaccagguugacuaugaacucacucuaccucugccugagugcugggauuaaaagcgugaagcaccaugccuggauuuauaguuuguauucuuucacuugaaauauauacaugcucaagugggacugguuuguaggaagauggaagugucauuccuuccuaguggauugugaguguugugaacuaucuauagacagauggcagcagccacaacugccagagaggcuugcugcaaacauuguaauuuuguaaauauuauuauuauuauuauuauuauuauuauuauuacaagucauuccuguaacuucaguaacuguuuagagauggugaagcugagguaggcuguauauguggagauucuaagguggaccauaaggacagggagauaggcugguagauguggagacacuaaggugggccauaagggcugguagguguagagacacuaaggugggccauaaggacagggaugagcuagaucgacuggggaaguagugagugagauuagauagaaaggaugggccuguguccgugaggaucaacaggauagauuauagcuacagagggucaguuaagaggaggaggguguggagaagagaggaaaugagguaggaaugagaggagagacugggcuaugcacagaauaauuauuaucguacacuaucaaagucaaagcaagaccaugaaaacauauuuaugcaggacggagagauggcucagagcacuggcuguucuuauaggggaccugggcucaauucccaguacccacaaggcucuacucauagcugucucaggcccucuucuggucucuauggauacaaugcaaacaaauggugcacaaaaaaccaugcagacaaaacacuuguacccauaagaugaaauaaaaauaaauguaaaaagacauuuguggaacuugaaaaacaaagacagugaaaauacuguuagaauuaucauauaugucagucaauguuucugcccuggagggauggguuuugagucccuccccucccuaugaugucucagguagcagcagacuacuaaugagagaggugcugcuuguuguucuaguucauacuuucaaaccccauuugugaggaugcaguguccuagagaauuuaaaaccaaaccaaaccaaacaaaacaguuaccuuugggaccaaguuuccgcccuuuugccaguaggugucacacccuccuugcauuuucccagcccucuucgcagaauggugcuguugggaaauuucccuguccuuguuccacgcgugcgagauggugacacuucccacuggguuggcugaauuugaauaucagcuacugguguaagcacgccugugcaguuguaugccuuguuaucuggguauccccuucaugccugggcucuggcugccuguugcugugugcuuccauguccgcuuaguuuuacaucuggccagugauuacucacuucugagcugggcagaaauuucccaugaccaggaggucagucaccuguggaguuuggagggugcuucccuccuggagaaguacuuccaggaugcccauguacagucucacuucaggcuugcucugaugugugacacaucagccacugucuccacagccuguugaucuugaacccaucagccuggguggauauucuaaccccugguugugucucagaagccugccccaccucucuccagcuggaugguuccugcaucuccguguagggaauguagggguguggggaaugcugauucugucuuggcaaugcuugggauugaacccaguuugucacaugugcuguauaaacaccccaacaugcucucagucacuggggagauccuugaaauacauccaccuuccucauuccccaagugcuuggauuacagguguguacuaauaugccuggcuuucuucugcuuuugcauuggacagagaagaccauguaaagaagacuuugggaaaucuaauauauacuaacuuauauuuugcauguacuauagaaguauauuagcuuugaaccugcugucugauagauccccaguucuuagguugcauguguauagcaaagacaguugcucacugggcuaccuugucuugguucuacagaugcaggauggcuggagcacuuguugaugagucuuuguucccugcagugaauaccgaugaacaucuaccaaacuuaaguagaaaaaaaguaaguaugugauuucuuugaggacagggugguuuugaauguaugaacccuuguauuuuuauuccuacaaauuauacuugcacaaauauguucugaguaucuuaagcaugccaaugaguucauugcuauuuuugcauaaaauuucuagauaacuguagaggauuuuuguauuuuaguuuuuuguucuuuucuuuaguuuaugaaugcuuugguguaaucuauaggaaauggaaaagauuguaguuagccuugagaaauuaaaaugugccccaaggcuaggcagccuuuaguugcuuuguuguuucuuuucuuuuuuauuacauuuuuauuuuauguguuuguguguuuugccuacuauaucucuguccuugcacuacaugcaagccugacacccauggaggacaguagagggcauuagaucuccaggagcuagaguugcacaugguuguaggccaccaagugggugcugagaauuaaaugcagggccuucucaagagcaaucagugcucccaacugcggagccauuucuccagcccccugguguuucuuaaguguagugcacuaggaaguaucaaagcacuugguucucacacaggaacugcuguuagauuuaaugaccuaaucaagauugaauccagugggugagaacugcauacuucuacagaguaaaagcaguaucugcgggcucuccugugcuucuagaagauagugcaugacuuauauccaucaugguuacugcaguaagccaggugccagaacaguggugacgcagcagccccauggcuucucuucugauucugggcaguucuugacugugacaugcugaagugaaagacuugggaaaacgcaugcagaggacaugguuuuucuuuaagaugcuuaguaagcucaggcccagcaggcaucgcugauguuucuugccucugauacuucagcuugaguagugaccuggguaagagcccgccggcuuacugcguguuagcgcauguaccugcugcucacagugucgcucugcuaagcgagcucuucacuuggccaggcugccuuuucuucaccguguaauagugugguuuugauaagcuaauuuuauguugcacuuugugaguggaccuuuccugaauauacucauagguagucaguuucuacaaaagggguuacgugugagaugugcauuuacuacuugugcucacaaacaaaauaaagauggaacuguuggcucacugugcaaauaaccuuaaauuuugugaucucaucaauagugugcaagggcaccucuaucuuauccagugccauugugcuaucuuuaaucuuugucuagucugaugcacaaauagugacugccugcaucugacacuuagcaauucugaaagccuuccuuauuccaaaugcaauugcaaguuaaacaugacuugagaaaaaucauuuuagugcuugguggcggggggggggggggagggggagacaauuucugcugucucccucuccugcugcccuaggcucaccauggcguucugcucaggaaggaguuuaaacacaucaucauuuuaucuguucccuuugucuggaucaugcuccccucagguccauucaccagacugcccucccagcgaucaggugacucugugcagaugucaccuugcuacagucccuucuaacccugugcuguguagaaggugugcagaugucuucuugccacaguccucucuaacccugugcuguaguaguaggucuuucugcuugaggcuguuguccugcuucugucacccugugaccucaguuuccguuccaaggcgcuuuauggauuuggaaccauugcugcuuugagauucugggaauuuuuuuuuuuauuauuuuaaagcaacugaauccuauucugacuguaggauagaaagagacccagcacuaaagguacaguguggaaugucuauucucugcuucccacauaccuauggacugggccucaugggaugcguacuccaggcaaacugcuaauccuccuaacagaacaguauggccaagcuacacaaacugucccgcuguccaaaggcagcacugguaacaucucacccugcaucagugagccugcugaacuuaagccucagcucccagcuuguaccaguuaucuguuaaaguuguucccugucacucuucgcccuugugcaagcucucuaugcugaggcccagugucugacacaagaaugugauaaugaccaaauguuuaccugacuagagucaagaacaaaacuggagcaugcggcugccagaaacaguacaauuucaaaauuagcagcagcagcuuagacaaggcaacgagacuccuuucuuuaacuaggauaauggcuggugugaggcaagcagagaaccaaggcuucugcugagagagaaugcuggcauggugaaagaguucagaacaugguuacguaguauacagccuuuuacuuaaucucuuaaguucugugcuguuaguaaaauaaugccucagaaauaaauauuaccaauucacauacaguguaaugaacaacucauuaagaaguucuuuuaauuuuugauaucauuaaaguuaccaaaacuguauggaaauggcuuucucucuuguuuuaaaaacagucagcaguuguagggacuggagagauggcuuggcagucagggucauuucucuugcacaagaccuugcugaguuucuucguggcaccuacaugguuucggggaaucugacacccucuuuuggccucucagcaccagccauucaugugauguauaugcauaaaugcaggucaacauuuacucacauaacaacaaguaaaucuuuuaaacaauaaaagaaaacaauacacccucacuaauguuuauaaccuuuuugccuagcacaaauguaugcaacccaaagauuuuauucuuaaaacaccagaaaaugacaaaagacuucaaaagaaauuugagaaaauggcugaagagcuacaaaggcaaaaggcagcucuagguaagccacaucccgugugccugacagcuacagggagguggggaggaaggaggcuccagcacaugccuucucacuuggaguagucacggguagagccucuggcaagggccaucagauaguccucacggcucaucaagucagugggauccugaucuggggaggauuacaggagaaaagcaaucuuguuucuuucuuuugguuuuuuguuuguuuguuuguuuuaagauuuauuuauuauuauacauaaguacacuguagcugacuucagaugcaccaaaagagggcgucagaucucauugcaggugguugugagccaccaugugguugcugggauuugaacucaggaccuucagaagaacggucagugcucuuaccugcugagccaucuugccagcuccagcaaucucauuucuuaauucugucucuuuaaugaaugccucaucuauaaugacaauuuugacauuuugguuucuuugaaaaacacagaaauauuauaggaauguguuuuuguuuuaaccccggcuguaggauacggggcugcuucagguuauccacagcagcugacugugacuugccuugugcucuaggaggugugugauuuugccagcuucaggauaguuucugugguuguauguuuggaauucuggggauuuuugagaggguagauaaaugcugccccuagaggaagggugaguuggugguugguuacugguugcucaccauuucuuaaguagucuucugcagagaaguuagauauucuggacugaaaagaucaaacuuaccccaaggaacucaaugccccuaauuggcgaaguagguuaaagauaacacugucccaucucccuuuucuuaucuaguguuaggguuugaaaggguggagaaggguggaagaaagaagaacccacaaaguagcaaauggcagcuacacagaucuucuuguuucauaucuaaaacagacaaaucauagacuuuguuugcuuuuaaugauguaggaaacaccuugggcucacuuccugugguuaaguucacacguggguguguguggaggaugagcaguguucaguaggaccacguccuaaaaccuggauauaaaacaaguuuuaggagccaacccacacucuggcuugcuggcuucuugcuaauuguauggugguguucaugauauugccuuaccugugucucaaugacuaccucuguacaugaggaugcugacaccugucaucauguagggccuggguacagcuuggugacuaauuuaugcccugaacugagcucagcaagggucagcuggcagcuagcuguacuggcugugccaugguucuuggggggaguaagacuaucugugggaagagagaccaacacuggagggaacagaaauguggggcuggggguggcucuuccaggaacugcugguaaggugugacgguggaaguuuguuuucagaugaugacguuccuguccuccuguuugaguccccucgcucacugguguacagcuccccagugaaugugaugaagaggagacugcaggauaugaaggagaagagggagaaccuuuccccuaccuguaaguggcugcaguguagaaugaaaaggaugucugcuggcgaacuacagaagaaagguuacuugaucucuacccuaggugcuugcuguuuuuccuuucugcagugcaugggucaagggaucacgcugcacccccagucuccuuaccuagacauuuugagugcuuccugaauuuaguacuuaauuucaguggagaccuuucuaguguuuuuuuccagaagaaaugugcuuuguaagguugaguguucuucaguucccuucuugcagcuccuucaucguuuucaguaucucuuuucuuuuucaaaaaaaguaaggagccggaaaaauggcucagaaguuagagugcuugguaccuuugcagaggauuggagcccaguucccagcaccacauuggguaacucauaacugucuaugacuccagcuccaagggagccagugccuucuucuggccugugugggaaccugcauacauguguaauuuagacaugcauauacacauaaauaauaaaaaacauuuuuuacagaauaaaauaauaaaaaacuaaguuagucaggucucuuuaaaaggagaauauuuuaauuaccuauguaguaguaagcacauuuuaauaagaugaugagcaaugcugugaauaagcaaagccuugccuccccacugcuuacacuccucugcugauguauguacaguuggaaugauacaggugugccuucugugugcggccguaguuuauuucuuacuuaauuuagaucauuagaauauucuuuuuuguuugugguuguuguugagacaggauuucucuguauagcccuagcugcccuacaacuugcuuuguagacaauguggucuugaacucagagauccagcugccucugccucccaagugcugcgguuaacuguaugcacuaccaugccagccacaucauacgcauuuuauuaagccuuuuccuucacuugcuaccauuacaaacuacacuagacucaucugcaucucagguccaugaguaucagccaugguaacaaguaagacugagaugaacuguagcuuuuacagagacaccaucaugguuuuguuggcagcugaagcagguauauagcucugucucaugugcauguccaaauugauucaacgcguauaugaacugagucagagauuuuuaaaccccacagcugaaaggccacuguggugagugcaugucuguaauucaaauccuaguauucaaagcuggaggcaggaggagcaggagcucaagaacagcuuguaaagucagccugaauuaacuuguuaaaaugagcuugucccuaaaaauaaaaauaaaaaauuuaaagcccccaacacccccccccuccacuuugcuuccaaaguaacuguacaaaggcuaaggcuauguauuucaguucuugccuagugugcacaaagcccuggguucaguucccagcaucagaacaacugaacaaccacaguaucugaggacuucugacugcccauaccuucuuuguauauaugcccuugcuuuauagucacuuuauuaaguuuucugagggaaacauccucugauuuuccuuuugaaaaaacgacuuuuagaggaugcuuaaguacuguacuuccagaggacacaagaacaguucccagaagaauguuggguggcucaaaacaucuugugacuacaacuagaagggaucccaguaccucuucuauacucaugucccauacccauacacagaaacacauaaauacacauaauuuaaaauaaauuuuaaaaaucuuuggauauguuuguuuugucucuuguauggacagcuuuugaagauagcgccuagagccucauuuauugaaucauugauguucuagauauuuucuuuaaaacugguuucuuaacugaaacacuguugacuuuuggggacaauuuguuauuguguagucuuucuaaaccaguugccccugucugugucagcacuggacuuuuacuuacuuagaaguaaauauuagaaacuucaguucucaaaccgaaaacauucacuuaauuugguuuaagcuucauacaaguuggauuuugaaagucccaucucaugugauugugugaucauguuuguggggcagugauugauagggauucauuuugucagucuuaaaucuacaguauaacugauauaguuuuuguucucgaauuauauuaagcuuagccuaaagguaagauuaauuuccuguguauaugggaucaggagcagaauggguagauaugcucuugucccuguccaguaggcaauucugccauccaguuauugaaacuugucauuguguuaucagccucccagauguuggagcagucucagcagaauccaugugucagucuguuugaaacauccuugaacauuucucaccaaccuuugaguucagguaaaauuguaauauguauuuuguuuuuguaacagacuuaugauuugaaaagugugugugugugucuccucucacacuguacuuuuugagcuagacuuuuucuguggagcucuggcuagcauggcacuucaauagauacccagcuagccuccaacuagaaccauguccuugucuccucgaguacugagauuacaaaaaugcuccaccaugccaagaugucgugugguccguucuaaccacucaagcagcugaguagaccuaaguuucuccaugagauuuggucuuaugguauuggggaccuccugcuugaacucuuauuagucccucccuggggauuuguuugauuguuugcuuuguuguggaaauccuugugacuauauaugauuuaaaugcaguguaaauguauaucugagcacaguuagcacuaaagaggaauuauucguguuuaauuaagccaugaagcauauuauugaaaagagucuguguuaaauaguauaggagcccuugaccuuuuuucaaggcuauauagcugucagguguugaguucuuuacacuucccucacguaaguccaugggggccuaagugaagucuguggaaacccuaaacaacuguguucaaaagggcuucaaacgccacaugaggagauucagcuagguguucuuccuguccgugggguguauucuggcagucuguccugcauguucugagcuuguuuacccauucaucuuuucuuugcucaguuauaucucccauagauuggaagcaaauggcgauaacaaugcuggcuuaccuuucccuauacuguucuugugucucacuguaucacacacacaccccaagucuccaugagguaggcugcauccccacucccauuucacagaagagaaaaccaggaggucaaguggauugugcaagauccugagguugugagugauacacccaggcuucugacauaaguagucuaagaauuuaugcucuuagugaugugccacacugaaucguggcuuauugaagagugauuaaugcauucaguuccuaagaguaaaucucaguaucacuccaacugcugucuuggaagcacuucagcagaggcccaguaucagcugaccuuugcuuuugccccucccuucccagagcacagcuucaaggacaggauaucucuguugccaccacucugcucugaaagccgagcucgaguuguuuaaguuagaaucccagcacugccuccagauggugucuuuucucuaaaaaaggaagccuucagcugggcagcacuguaccaguagaacugggucugaguaaugaccacagguucaggaaagugagcagaaagugcugacugcccucuaguacuucaguauaaugagaggacaguagcaugcugagucccaggaggggcuagcacugugaccugacaggaucaggagagucacaggugacacugacacugagcugguuuugaaggaugaguuguguuuacccacagcaaaaugugucagaaagcuggggucagaguggggagccugcagaggugauggacagcguaucauuacuucugagagaagugcagacuucaugagagaucggaauauugagagccccacaugcuucauuugaaauauaaauaaaacaugaggacuugauggaagaacaggggacagauaugaggagccguguucuguuuaugaggagaaauggcuuauagaagaccaaagccuagccaagcaugguggcacauaccuuuaaaccaagccagcauucaggaggcagggacagacucucucuugaguuccaagccagcuagaguuacacaaugaccagugacacccugucuggucacuugcacauuuuaaaggcgauucuuuguugaucucugcagaugaauccuuugccaguggcucccacucaucuuucggugauuccuguggagaucaagaaaggaaacugggaagaucugcuaaugagaugaccacggugacaugcccuuccucaccuguguugagggcaagcaguuuuuauggcucagcaucacccaaccaucucaggcagccacguccucagaaagcuccagacaguccuucaaaggagagcaucaacugucagaaggaugcuacaggugcgguagcugauuccgagagaaagcaagcugcagguguaucucagggggugccugaugagaagcucugucugucuccuacgauguccaucauagaagaacaccaaguacgguugggacccaagaauucuucugcaaagagaaaaagggcagcggacuuggguucaucuccaaaaggaaaacugaagaagagguacaagagaaagucugcucuggcaauacaguuauucaaguccgaccagagcccgccguccacaaucagacucauuccgggaacuccugacguugaggcuucuuccuaugaggacuauuuuuccccugauaaucucaaggagaggaauucggagagacuuccuccugaggcucagcaacuagcaagcccuucucuguuccacugcagaggucucucaaagugggagcgaagaaacaugcuggaaaugugugauuuuaccugcauuggugaaaagcacagauccaucagcagcauuagugacuuaauuucaaaaagugccucuagucuugagaaaccugucaaggaggaagugaauacagcuucuaccugcuugcuuuugguggagaccucugcuaacgacagcccagggcuuugcagucagccuggcccucagcugagggaugacacaggcccagagggaagcagccacccugacacccugucuaguucugcccaccacaucacacccuugaaaggaaauaguacagaaaccagagacccaggugauggaaaaggcucccccaaagaagguagcacgccuccugcaucagccucuccugaagaugaaguacacaucuguaaucucaguuugggagaggauuguaauguagaaaagucuguagaagaaaaggagaacauagccacaggauauagugaaaguaugugagccucauuucccaaguauuguuuguucugccaguguguaauacugugcucguauuuuaaaucuguccuuaaucuuuauaauuuaaguccuucccccucuccuuuuauuuuaaggaauugauauuuccaaugaugcucuugagggauaggugggaggcccugaccugaacuuuguagucaaaugugucaccaugaaaauaccuccccaggcuuuguccuaguggauuaaaagaaacaguagugcuuacuuuaaacuguugaccuguauaccuuuccuauaugccucucucacucagcaugacugcaccagagacauaacugauagaggaauuucuuuucuuuuuauuuuuaauuugaguuuauuuaguaaggguuuuaaugugaggaaugcaguaaagaaaccgccaaaagaccgcuccauaacuaggaagguuuuucuuaugaauaagaaaguauccagaagcaucuggaauaguccaacacagagagaaagagaaccagacuggcuguggccauggcgaucugccagagaagagagaugagcaagaggugaagagugcaauucaagagugguggggagcaagggagcaagagaugcagggggugggggaggaagggagggagggagagaacaagagagcgagagagagagagagagagagagagagagagagagagagagagagagagagagagagagagaagcugaggcuagcaggaguacccagggcugagggcucugaagagagcugggaucugagguucaaagguugcagguuggaggcuaggguggaggcuuguauacuaaaugcuaucaaugagggagccuggcggcagcaugggcuuugauacagccacagauacauguuaguguagccauauguccuuucugcugcacauaagaaaagugacuccuuuuggcuugggaacuauuuucacaaguuccugaggaaggcuggcuuuuaucuauccagauugaguugggcguagacucaauuuugggccaagucagaaggcuugcccugguugacguagggaaugggguugcccguuugaccuggcaugcuucuacuguagaacucuagagagcaucagccaugauuuugcuaacagaaacuaugaaaaaguuuugaaauuugucaucacuguuuacuuugggcacugaaacuuugggcaauguuaaauaagagcaaacauuaauuaagacauuuugcucaauuaaaaauuuaguuuuggaucucucuccagcccccaaguaacucugguguggcuuugauuucugcuuauuuuguaucaagacuaccauucaaauagguuuguuuauuccaaucuguaacuuaauuauaauuacuaaagugauuuauuuguugaucaacaaauaauaagcuauaugauuauagggauuuaggcaaagauggcaaaaauaucaacagauuuuugcaaaguugaacucagccuuugaccauuauuuaaguuuggcuaauauuaaauaugauccaacugacucuugaucaguucuacacuugaggugguuucacccacuguggcuagggcagcuguguugggcugaaauaaucacaguucuagcucuuugagaauaaacucaccuaaauuggcucaguacaucaauuaaaugauuuuuggauuuuaagcugguaaauagcuuggguuuugaauaauuuauauuauauucauaauaguauuguuacaucuagauuauuauguguuuucaaaaauguauaaaauuacauagacuauaguaaauaugaaaaaguauaauguuuugacaguucagaauauccugucuuguguuuugaguuuuuaucuuuuuuacaaagcacuugaauauuauaugauauguaaauauaauuuaaguggggcaaacagcccggcacacccuaaacccuagcacugcaggugugcagucauuagaagaauguguguuucuucauccagggcucaaccuuccugucuucaguccagaccauuaggcuucagaaacugcaugaagggcaugggcauuggguggcacuccaguacucagaggacacugggaaaugugcugauugugaagugggccggcuugcugggacacaggcaggggugggugugacuaaguuugacucugauggaaauauucuguaaauuaucacgucacuaccacaagacaacaugggcuccuaagacaugaaaaccccucucuagccuaaaucuaagcacuuuuuuauacuuaguaacauuaagaagacucacgaauauuuuauauuguccacuaucagcccaaucuggauuugggacaaucaacucuuuggagauccauccuagauacaaccauaaauccuugggcugaaacggaaauuccauacuugccccaaauagagccaggaaggcugcucugagcaucagcuacacagacccucuauccuucuuguugacaugaagggcuauucagugccauuccaccccacuuaagcuugcugacucuaagauagugugcaaugaggcuucuaaagaaagcaaccaagaagucaguggcugaucuugaaacagugggguauaaucauuaacucuucacauuuuuauucaauacuuuuaugaacaauuuaacaagaaguuuccuuuguuagaaagaauaaaccuuuccaccucaauuucucacuuucugccuguguuaauucucgaauuccuauuaaaggauagugguagacaugcugcgccucacaucuguuucuacuucguaaaaagagagcugaaggaaucaguaugcaccccugcccccaacagguucugagguccuugaagaagccagaugauaaaggcagauagaacacggcgucaacugguggguguauuucagggagcacaggcgugagagagaacagccagagcuggggaagaaggagaguagaagugagagauaauagaaugagagacuaggaagagaguguaaaaagagucagagagaguagugagacuagcugagaaggaggaguaaaacucgguuauaaagaggaccgauguuaucuggaaaaagugaagcccagggaagggugaaggucuguggugcuaguguggacuucagaaugucuaacugguggcacugagggagccuggugccagcacgggcuuuuaugcagcugcagguacaugucaguggagccaugugucccuucugccagacagaagggaaaagauuccuuuuggcaggugaaaccagugucagaaguuccugaggaauuccggcuuuuauccaacccucagaaauccucuuguaguucaggcagugcucauuucugacuagauagacuaccuuuuggaguuugaggaguugaagcguccuuugguaaacagugaugcuggagaguauagguggcuccaccagguacccagaaggcuccucugaggagguuuuauggaccuuaggccaggugagagggugugcuugugucuacuggagguaaguacaaauggccgaacauccugcaggaaggaggaagccagugcagcaucaagccauugagccugcgaggugaggacagugaccacaguguggcagcaaucugauccuugagaccuucccuccccaucgagacaggguguuccaguuuguuuuauagugugaugagaaguugcuggggauucugagcuggagcaacgaaaucugauuuguuuucacuguaacccuggauacucugaagaacaaacuguggcuuaguguguuugcuagaagcaauuacugucaacaacagcccuuccagauaacuauggugcauauaaacaugcaaaugaaauauauuuaaagggauucucucauaugcauagaacuguauuauccuguugcuuuaaaugggucuuuuaaaaacucauaacaauaugucagaugcccuguucauagaagauacuuguuucuuuuaguauaaucuguguugaagaucagugguauuuucuguagugggucaaaaggauacaaauagagagaaauauagauaauuauaaaauacagauaauuagagaaaagacauucuugcaaaacuuugauugauaaaacacaaaauugaguauagucuuggaaugcaugucugcucuugagcagauuucuuggguggggagagaaugagugacccuguaauuuaacuggaacuccgacaggugaguucccaucaccuaaccugauugcaaauaauucuuuaagguuauuguggaagguguuaugcaucucacgcuugagggcgccuuuucacaaacacuggucuuguccaagucugaugccaagggaaugauuuucagacuuauugggucuuaaagguggcauuuauguaauuauagguucccuugccacaagcaucuuccagcagguccugaucuucugcaugcaugacuugguggugagaagauaggugggagcucuuggaucaugcagggaaagagaucuugcaguuaggcuauagguuuauucuuuuauuaggucugggaaauguuguaggaacuguaugaagucugaauucaaaaagaaaugucugcacccaaguuacguggagauggguggaggucuugcuuucuguuuuaacguauuuauuuuggaagcaagaucuuacuguguagcacacuuggccucuacgccgcugugacuguggguauguggcaauacaccacgcuucauuuaucuuucgacggugcaaggcaggagguaugagaagcagcuuggugaacauugagaugacacucuuccgccucugcuccuaacaugcaguccagcugaaccgcccaguagauaaaguuugccagccgucccgagcaccguggugucugaugcagcuccuacugccugucacuagugaugguaacgcaggagcuccguaugucucaucugaauaccagcagaguuaguacuuuccgugcuauaccccacaucuggccagaucagauucaaugcagaucugauccugugcagcgagugguggaauuucacgucagcauuuuauacauguguguucaguuaccugcacauuuuggccacguccacuauuggguucuuuuacaguuaccagcuguuaggaguugaaugauggaccacuguccuuccagcagaucuggcuaccagaucuuacaaaagacaaauugcagaugcauacacauuuguuguugagcaaaauggagaaagccuuccaaguagacagaucugcugaagaccuagccugugucccuuaacuuaguuuccuguuuggggcaagccucuauaaaaguuaaugugugccucagacuaccuaauaugucugucuuucaucauaggucauuuaggauucaagaucugggcaucguccgcagggauacaagcuucaacuaauaccagauguucaugcccugcucuugcaugguuguggaguguuuuguaauaauauuccugccaacccauucuugacuucaagaaguuauccaaugggaagcuuucugacagcuugaggauaucagucacagcucauuugcuucaugcauccuggcuggcaguuaacaaggcauuucaaaacgggcuugugcacucaccucccagguguagcagcugguagcauaggaguggaugacaccuguguuuugauggggccaaacauguaccuucuaugagucuauacugaaguauucuaacaaagaaaccgucauuucugccaaguguuuaauccuaguguguuagucugauggcagugacuggaacuagcugggcugaucuugggaggcuggaggggucacugccuguagcagcucugggcuuaucaguacaaugaggcugugacagacaggccuuucacgggaccaggggcuccugugauacagggaguuaguuacugagccaguaggauaugcugauaaugguuguaugggaagaucacaagcucaggaucuuguggaaugucugucugucucugcucacacuuguaacuuuuugaguuuucuaucacuguaaaaauguuggagcugggguucucaccuauguguuuuuguugagacaucgucuugcucugcauccuacccugaccuuggagcagcuuuccuaccucagccucuaaggugauggaauucuacuccugucccacaguacccuucugcuugauccuuuuucuuuuucucuuucuucaguugcauuugauuauuuuguggaaaguagggcaacacagcauguaugcagugaggcuagcgaaaaugagaggcaucuaggauuuacaguguggauagaacacugucuaccccaaccaaccccaaccccaggccccaacccagacccuagaugagaguguuuggaaauugggccuucggaaggagguuacauucagcugagaucucaaggcuggggaccuuaugauguaacugguguuucauaaagaggguaagaaacaccaggaauucuagucuccuugccugugugaacaggccggggguuggggagaaggcucaccagaagccaauuaucaguguccaguuaggaucaacaucuucgaagucucuggaacaagagauaaauccuccuuaucaagagacccaguuaaguguuuuaagacauucaucagacugucguauggaggaacagcaguucacuggagcccaacugugggcagguggccaggcuucaccuaagacacuccaaauagauaccuguuaguugguugcaucuauccauccauagacagggaagguacuuagcaauguagggauagaugguguuaugggaccucaugguguccggggugguggggcuguuugcacacuugcagcacagaugugacacuugugaaagacaggagagccaggggagggugcugggagaugggaccugacuggccuuagagcagccuugcaugguagagcaugcgagauguguugagagcuaugugcuugcuuuauucugugacucgggggucuuauguccccuuaugaauauucuaucccuaaaucacuucuaaccucagaucugaaagaugauuuaaaaugaggccuguuagaagcagagaaguucuguuuguuuguuuguuuguuuguuuuuaagauuguuaaaagcauuaggaaguaauuuagaaaguuggugucacuugccaggugacaaaaacguuugcuaccucuuagaguagacucucacuaacccucuaccugcuugcuccaguccaucauccucuuaaagccaacugagggcuucagugggugggcaguuaucugagauugagagggacaugacauuuaaaagaugccugaagaggaaggggauuaaugugugguugguuugucuccaaagggauccaguuuagacuuuuauaggcaaagaauguugaccuuaaaauguuuauagggccgaggguacaaauaacagcuaguuugaauucuggaaaacacuuaacuauuauucuguguuuuuugaguucaugauucauuuuuacacuuauuuauuguguacuguguguaugcaaggguguguugggggggggaggcugugucaggacaaaucuuagcaguucucccuguacaccauguacgguuuggggguaaggcgcaggauccuccacucacugagccaucuugcugacccugcuuuuauuuagauacaauuccguuuugaagaagugugacuccucaaacuuggaucauucucagcuuuaucacacugccccaccauuugcaaaguagacuuucucaugguguacacacuuuaguuucuguagguguuuuuaugauuuugccuuggagcauauuuauuugcaugucuagccacauacauugaaccaucugcagcggcacccucaugucguccucgccaauaugugaaccagcauauaggugggauaugcaguuuaguugauguaaccuuccucggcuguugcccuccaacaucacaaauguggucguauaugucuugugguauuuucuccuuuaaaaguccaagaaaucuuuaaaauaagcagucaccuggagaauaacagcaauuaugcaaggcuacagugauaaaggacaacucacauacauacacacgcacacgcacaaacgcaucguucuaugcaccuggaauaucucggagccacgugggaugcaguggaaucucuuuacuuguguaucuauggcaagaaguugguuuaauguaaaggucuggcagagagcaauaucaaguaugugcagauuaauaccuaagcuuuguacggaugaccacucacucuacaggaucuaagcauaaagcugacauaauugauugcaucuaagaaguaucuucuccgacaggcuggcuuuuauuauuauuucauaauuaagaguuguuuugaauggugcaaacaugcagauguggugaagugcuuugggcaaucaugaauauuuucuuggacaauugagggaauugcagggaguugccuacuagcucgaacuacagguuugggguuuuuuuugguuuguuuuguuuuuuggguuuuuuguuuguuuguuuuuuugagaucauauauguguaugguaucuauauauagucaauuguguuuauagcacauacacgugucugguccaaggguauggcauugcucuccaucuuccucuuugaagcauugucucaccuagggguggucaauaaguuugggucugguuaaugccaugguaugugacguuuuuauuuauuugcaagucuuaacauuuaguuuaaaaauaaagaacaccaccacugcaguaugucuggccuggcuagucuagcacucagacuugugcugcagugccucaucuaaccaguucucucucuccaguucuuaaaaggucucggcagguuaugguggugauugacagagccugugguauucuguuccugcuaagcagaaacagaaugcuugguuuuuguuuagcuuagccuacauuuguguuugauccacguuguuucuagcuaacguccacucuacuuguucuuuagguguuaaaaauggaccagggcggccagauccuucagacagcucuugcacaggccuugucagaccucagcagaaaccaaagaaaagugagaaagaagaaaaggucaguggguaaaaauguaauugcagaccuucaggcacucagaugucguagcguucuacuccguauuuacgaagcaaauuguuccacgcacuuugcguuuauuuaagaauuuauuuacagauggaugugaggcaguuggacuaucguuacacagaggucugaggucauucaggaugaagugucagcacuaacgauccuagacaaacccagcuuccuccagucgcucucgagcacaucccuggcugggaacaaggcuccuguagcccucaggcagagcggggccccagguauccaucaucugugaacacaucgaggccugcccuaaaacccuacucucaauagucacaaagcuuaccuagggucuugggaaccugaagucagcagggcagacagaggccacccuucccggucagaaacauagcugcggggaagcuggagucacugagaaagguagaggcauggagaggucagugguggcgcuuuugacacuugguaaguuugaggaagaaaaguaggaauuucuugauacgaaauuuagauuuuuaaaguacagcuucccaaugugccgaucuucuauguacggugggggcaggaauucauuugccaucugguauuguuaugagucaacaaaaacuacugaguuccguuugcugauuugaaagcggaccguaggauuauagaauuacauuaguaaauuaaguacggcuucuucuagugaacuucacuuccagauuaggccaguaucuguccuucccccuauuccuccuauggaaacugaggacuuuaccugucugguuugauccuuaguagguuuuaagauagucuguuucaucugaaauuugagacuuuaacagggcccugguuuuaugcauagugcaaauuaaaggguucuauuuuaucaagcacagagcuuguucuuuuccucuuuuuaaaaucuuaugauugaaacagagauauagcucagcaguaagccugcuaggcaugugcaaggcccuggguuugaucuccagugaugcagcccaguggcaggcuugccugugaagggcaaggcccuggguuugaucuccagugcuggggaaaaaaaaugaaaaccuuguugacuaaauucuaaauugaaaaggggguuucauuugcuaauucuuaggcuacaugucccugugaaaucgacaguccuggugaucauggcagaguuugaaacuccauuguuucucugggcccuaaugagcuuucucucuaauuaaagaggcaaggguagguaaugucccaucccagcagcccugcagagcaggccggucagaguagauaaugcugaauuugaauucggugucacauggagauucagggugaaguguagggagucagagacuggcaagugugggccccgagaaaacaaaaaucugugugucugcauagaugagguucccugugacagucgcacaaacacagggcugcguucgcugcgagccuucuugacagccacuggccuuugcuucguguuugauuuguucugggaaguucucagcucuugcugcuucugcccgcuuucucaacuccagcaguuggcacugcagucccgcguguuguccauccauugccucugggauggaugucugcggugcuucuuuccucuagcaucuucuuaagcaggauuucacucagcccuggcuggccuggaacuugcuuuguaggccccaggcuggauucaaauucagagaugccucuuccucuuccuccucccccuucccccucccccuuccuccuccaugcuggcauuaaagauguacagagccaagccuggauucucuuguaucuuugcuuuuuuuuuuuucuuuuuaauaaauuuuguuuccauuccccccuuuuggucacccuuuauaaguccauugugaugcuaaaccaacacacugaagucugucaucuguucauugcucuuuuaggcccuuggaguauuuauuauucgaauuuauuuuaucauuuuuggcccugugccaugcaugcucauuuggaagucuuugccaacaccucugcucucccuugcuucuuuucuuauucucugccguuucucacaguucucaguccuauaucccacaggcauccagucaggagugggaugguucagaucugggccucugucacugggaauccagcuguucuagggacugugagccuuagaugccguguggcaguuccggucucccagcugauugccugggcagcauugccacagacacugcuugccuguuuguauuuuguauaguuuucuggcugauugcaauuuguugguugauucacaggacucagucuaccacucuugggaacuaugcuguggcaauuuguuuaugcuuggcccagggaauggcucuauuaggagguguagccuugcuggaguagguguggccuuuuuggaggaagugcgucacuguggugggcuuugagcuuccuccuagcugauugaagaugccagucuuuuucuggcugccuucacaucaagaguuggcacucucagcuccuucuccagcaccauguccacuugcaugccaccaugcuuccugccaugauauagauggaaccucugaaccuauaagccagccccaauuaaauguuguccuuuauaagaguugccguggucauggugucucuucauagcaauggaaacccuaacuaaaacggauggguuaauuuuuauggucuuuuuaagagagaagacuuaaaauggugguauuuaagaaugcauacacacacucauacauacauacauauccauauucuuuuaucgauugguuaguugguugugugggguauaaaacuuugugugugcccuugcaugcacguauaagucaauuuugcugcacacuuuauuuccugaggcaggaagugaaccuggaacucggugauuagcuagacucuuagucaucaagcuucagggauacccuggucuccaucucuccucuccccucccccaaacugacuuuuuucagggacguuggagauuuaaaccccgggcacugugcaagcacuucacccccagcaucuccccauaugcaucucuuuguagaaagaguaaggaaaaauuaagucagaagaaaaaguuucuaaaacaauuauccaggaaaaauacauuaaacaucaaauucauuuuucugguuguuuuacacuagcuagaguuaucugggaagaggacccuuagccaagaaaauggcuccaucagauggccuguccucaagucuugaaugcauuuccuuagucagugguugaacugagagagggcaugcacaggggcauuggugucugugggcaggugggccugacuguguuagaacgcaggcugagcaaaccaugaggagcaagccaauaagcagcaccccucucuggccucugcaucagcugcugccuccagguuccugccucgacuucccucagugauggacuuacaagcaguaaaguagaauaaacccuuucuucucaaguugcuuuugguugugguguuuaucauagcaauagacacccuggcuaagauagugauguuguuaccucaguuucucuuuaagagugaacaaauaaaguucuguggaguuuauaaucccaagacuuuagcuucuaauagaauguucuugguuugacgcccacuuucaaugggaaaagucacuuuacaaaugagucugaaaucagccccuuuuagauugacaguccuagacauuuguaaguuuauuugccaucuuuuuaccuugaggacuugguuaaauaguucaucaccucuccucuccuaguuuauaguauguaggguagaggcagugaugacauuguacgucuuuccagggaggaagggaaauugaccaaguauagaacucgaggaaacucagugugggcuucaugcuugaacucgggaaaguacaugaacucugguccuccagggcuuuuuuuguuugcucuguuacuucugggcuuguuauuugaaagauuauuauccccaacaaaaaccuaacuggaaucaucaacugcauaguucuuggucaguggcagaguuuuuaaaaaccucauuuuggggcucugcguggcaauccagguuguuccacaggaagacaagcugugggucagagcacaaaggguuuacagauggcuuucauagacgcaaagccuuggggagaaagaggagcaaacacaccgcaccuauuuugacgaggucuuuguuguucuuuuaagggaaaccagacacgagauagaaugcuuacauuuguuuguuuuauguaucaucaucaucaucaucaauuuguugugcgcauguucacuuguguauggguauacauguguaagugugcaugcaugugugaauaugcaugcaagugugaguauacacgugugagcaugcaugcauguggaagccugaggcuaacacuggcagucuccucccuugacugccuuucccguuauucacugacucaggcaucucaguugaguccagagcucaccgauauggccgggcuuccuguagggauccucuguguccacccugagagcacugggcuuacagguugguuaccacacccauccuguacauuuguagcucugaacuucagcccucacacuuacacagcgccauuuccacugagccauccccuaagccuccccuuuuacaguuuccuuuguuuuacucuguguguggacguuuuaccuucauggauaucuguguaccauacuuugcacuacacacaaagaccagacaaacaggcaucagaucucuuccgacuggaguuguagauuguucugaguugccugccauaugggugcugggaaucgaaugugggaccucuggaagaacagccaguguucauaaccacgaaagcaucucucuuucccuucucucucuuuaccucaagguguuuucagucuuuuguugcgcucucuguccccacucaacccccacucuccacuagaaucauugccacauaguggguguguugguuuuucauagcuguuccccuccuaggcagguggguuugcaucaguaagaaguggagucucuccucaagguagcgugcugcaguacaucacuggaguugacucccaauuuaaguccugcucuuuccuccagguaagugucuuaauaucuaugauugagacaguaacauuuuaugaauaugguuuuccaguuugcaggaauuccaggaauuuggcugugccuuuagauagucugauagaagcuuugaucucaaacuucacuuucgaguuuaaacagcagugauucacccaaaugacaguugauauuuguuuuucuucuugaaaauucaacaugaguauuuguuauucgucgaguuggggaauugucacacuuccucuaagaugacacacuuuauaaaauguccccguaaacaguuuccuguuguuuauuccugcugggugugcugagauaggguggaccccgucaccggacagaugggguagcagacacugagcuuggauuuauaacccaguugucugcugaucugcaguuacuuugauaaagccuuccuggaaauccaaagccaggacuggcagaggugggcugugcucagugguggugugggacucaacagcacaugcggcuuugugaagccauuuagaaaccagcagcaguauauugaugcccacaguggcuguccacucccacgagcaugcucguuuuguuuuguuuuguuuuguuuuuucuuguuauguaugacagaaaauauuuccacagaaaacauuuaauaaaaucuucaaaggguuuuggguacauugugacauguguaacucagaagucaccaaauacagcugugguggugcgcguggcuggaaucccagcauucaagaggagggaggcgggaagaucaguggaaacucaucccagcugugcauggaguucacagaagugagucucugccagauaaucacuaacaagaagaacagugugaaugggguuagccugagcuaagugagucccucucucagaaccgcagcaggagagugccuguuggacagauucuccuagaccucagugagucgugggccccacacuuggaggccagagugagaguguacuccgccccaagaauccugggcugugcagcagagggagaagcugcuccuggagucuggugagcuggcugguaagccugcacgacuccgagcaaggcucagucagcagguccccucuaaugcuucauuacuucugguugagugacagaaugccuuaaaaggcaacuuaaagaaggaaggcuguaugguggugugcacugcaucacggugggacgccauggcagaagacugagacaaguggucucauugcaucugcagucaggaaguagcugaaccuuguacucagcucagcuguuccuccucagucagucagggccccgccgcaugggcuggcgccacucacucauugcguuccuguggugauucucuaagucuaucaggaugccagugaagcauuaccaccccauacauguagcugcugguaucuaaggccuaguuuaugaaauauauuguuugggggauguuagccaaaugauaguuaacccugguaaucugcuuagauauauccaaucugccaaucugaaguuuacccugggaguaaagaaacuucuuuuuuuuuuuuuuuuaaagauuuauuuauuuauguaaauacacuguagcugucuucagacacuccagaagagggagucagaucuccuuacggaugguugugagccaccaugugguugcugggauuugaacucuggaccuucggaagagcagucgggugcucuuacccacugagccaucucaccagcccguaaagaaacuucuuaugugcguuuccgcucagcccugcacccccucaagccacacuugcccuccagaaagucagcaccaugcuggugacgagaccaccaaagcaccccacacugugucccccugugacucagcgaagcuaaccgcacucguguuguucuuacuaguucuuaguuggugacucacuugugucccauauaaugugaggggagucuuacugggaaguuucugggacuaguguucucucaaggaagauaccccugggaagaagggguuggccuuguccccuggaacauccacagcuggaggucaaagccaagagagaauuaaggaaaggaaagcauuggcaaggguaggcggcaaggccugcaagccucacacgguuuccacagaaaucagauggccgugugccuaaaggcagggcugcuccagugaggaacugaucggcauguggucaaggcagaggagguacggccaggagacuugaugcuguuuccaguaucccuggagggcuguggaucuaagggugagaugcuucaguuaggaaccacgcacaccacguacagaagcacaugcccagugccccaagcagagaccucgcuggagacugucgcuuaccucagccaguccacacuuccuccuccucuccacgccuggcuuuuuauuccuuugucuuuccuuaauucucuuaaccuuuggacccuuuuaaauaguauuguucuguaaauaacugggacuauuacuuguuaauuauuaauacaagcuaauuuaggguuuauuuuguuuuuuuugguuuuuuuuuuaagaaaagaguuagagaaugacauauaaaagcugccaauuacaagccaaugaggcauuaucucaguuaaacuaaauaagaggcauugcgaauagacuuuuggcaugccuuuguggcuuuuggauaugagcagagauucaguuuaucugucggugucgguccaacaaaaucucaugucuguugacugucagauuagagcaauuggggaugagggacuuaucuuuagccucaaauuuucaacaagcauguuauuauaaauuauaguguuuuauuuuuuuuggaauuauccuguuuuucauuuuagaaucuauuugcuucuugauucuguuuuacauugaaaaacuaagucuguuuuaguguuaauagaauucuuucuuuuucucuuuuuuuguuuuuuuguuuuuuuuuuuuuuugguuuuuuguuuguuuguuuguuuucuugagugguugcacuuccuccaauaaacuuuuucuuuuuuuuuuuuuuaauuaaguaagugugugcuugugcacacuuggguuaguucccaaugaggucaaaggggguuggguaugcuggagccagauuuaauuggcaguugugaacuucccaaacuugaguccucuggaagagcaucaagugcucuucaccacuaagguauaucuccagcccauuguauuuuuuuuagaauaagauuuacuugcuuuaauauuguguauacauaguuuaccuguguguacguaugugcacuaucuguguauaguaccugcagugcccuuggaagccagaagagguuauuggaucuccuggaacugaagucaugggugguuggcagccaccaugugguugcugagagccaaauuuugaguccccuguaagagcagcaaguacuugaaaccauugagccacaucucuagccccucguaugccauuuugaaaacaguuuggauagcuugcuuggauauugucuuagucaagguuucuauuccugcacaaaacaucaugaccaagaagcaaguuggggaggaaaggguuuauucggcuuacacuuccauacugcuguucaucaucaaaggaagucaggacuggaacucaagcagggcaggaagcaggagcugaugcagaggccauggagggauguuccuuacuggcuugcuucccuggcuugcucagccugcucucuuauagaaccaagacuaccagcccauagaugguuccacccacaaggugaccuccccuccccucuugaucacaaauugagaaaaugccuuaagcuggaucuuguggaagcaguuccucaacugaagcuccuuucucugugauagcuccagcugugucaaguugacacaaaaccagccaguacagauauacuauaaaauuauuccuuuggugacuuuuuaguuuaauuuuugguagcuucaguguagugugcugugaacauaugucucuguuuuuccaacccccuuuccauaauguccgugggucuuggagggauuguuauagaugccacacuuagggaugagugcccaacagccauugguucucagcauuuuguccugucuauguuaacugucucacaucccaaaaagaaguuucucugaccacaaaggauggcugcgcuagccuaagguauaaaacaggaaagaacguuggcugcauccacggcgccgaugccacacacuuggaaugcagcucugugucaguccuuccaauagaccccagaagggaggugcugacagagcugccggggucugcgugugggacaucccagagugauuuugaggggguguguguguguguguugggguuuuguuguuggauuuugcagccuuuguccuuugccgugguugauuuagccuucucauuuuccauagucaguguucugugaaucugacagugcucauguauguggauuuauaccaggaguaaacaagauaggucauauuugaaaauacuugaaugauuuccucaguuuacccauuuuuucuuucuuuccuucauuuuucuucucucuuucuucuccuacuccuccuuuuccuccucuuccuccucuuccucauguuuuguuuuucaaggcaggguuccuauguguaguacuggcuguccuggaacuuuaucugugaguuuggcuggccucaaacucacagaaaucucccugcuucucccucccaagugcugagauuaaagguauucccccaccaccugagcaguuuacgcauuuugaaggaaaaguagcuuuacuaucuaucugaaagucgauauguaaacccaaacaauuuuacaguguuuuauuucugaaauauuacucuuucucacuaauaaaaugaguacauguguuugguuugaccuaccuuugaucuuacuaaaacaaaaucaauuacaguuuuccaaugucaugcucccuccuuccaaaccuucccuuguuuccuuccucccucuggacucucugaaacuacuacuuuagaaacuucacaaaggacuuuugcuaaggucaaaagcagugcucacugugugcacauagcuauuaaugggguucauucugggguuccuguugacacugugugaauaucugggccugggacuggugcuuuucucuucaggacacaaucguaccuguuccuuugccagugaauaacaauguucuaaaccaguuugccuuuucuuucuauagcaucauucugcaguacauaccuugcaguauaagaagaugugacuaaaauaggacuuggaaaacugaauuuuaaaugaauaaauugcaaauaauaacaugaagguuucagcuuuccuugaaucuggcuacgggaagcaguucaguguacuguuggugcaugucuugugcgcaugucuacccauggagaccagaaggguguuggauccccugaaaccggaguuacauucaguugggagcugcccucuguguacuggaaacuaaacuuaguuccccugcaagagcugccagugcugaaaagugguugguuaucuugggacauucaggccacuuuugcaccagcaggaaccccuugccuggcaggucaguauuucaggaguugcaguccucagccaacaaagaccaaugguuccuuucacgcccgcagccugaauaguacccugugguaccacaaaguccacaugaacucaugagugccucagagaagcccuugucauucuguuccccaaaguggucugcgagugaaguacuuagaaaggucucacucuugccuacagguugucauauguguggaacucccucugcagggcagugaggaucccgguccguuugcucagcacucuccuggagccuucacuugucauguguuccauaugucccugacagucucucuguuucagccagacggaugucuuuccuuugcccugggauuguauuuauaucugaugguagcuguaaucuaaguggauucugauuguucguuaaaguccuuuggcccuugauggcagucaagaccucuugugugucucuccagucccauugugugcuugcguauuguccuuguucacuaaauauucaguuccuaaaggcugccuaucuguaauauuuuuuuucucggugauuacauguuucuauucauaaauaaucuuuauuguuguuuuuguacuuuuuaaauguaucuuauuuuuaagauaauaauauaaaugauaacauuucacccuucccuuuccuucaccaacccucucauauacucccuucaaauucauggucucauauauuuguauaucuauauauccuaaauauaaucgccucauucuguagaauguuccuuguaguuauguuuugucagcugaucauuugguguuugaugguucuucucuggagaccauuuuucccgcucucaguauuccuuaguugccuguaguucucgugcagggcugaggcguccguuucagcucaggcuuagguagccauguugaugagagucugagucuucugacaucacuaggagacaugaucucccagagaacucccaguuccuuuggcuucuacaaaccucucuacccccuuucacaaugauccuaaguuuuagaugccacaguauuuuguagauguauccauugggacuggacuccacagcucugcauuuugauuaguuguggcuuucuccaauagucuccaucgguugcagagagaaguuuucuugauaagggcagaggacuauauugaucugugaguaaaaggacaacuauuuagaauauaauuaggaauuaggcaguuucaguaacauggugguuguagguuauucccccaaguccaugaccuuacuaaccuugggcagguggaucaggguccauuuccuagcguggauucucucuuguugaguggguccuaaguccaauuagagagcugcuguuaccaccaaguugugugugccacuacugcaccccuaggguugccaggucaaugcuggucaugguugugguuccuaggugucauagauggaugaaacugcuguugcuucccuccuuugaaagcuaacacagcacuuucuguaccaagaaagagaguucucaggaagaggcauuuaggucaguucaguucagaaccucugaacccuguacgugaagugcauggugucuucagcaauaaggugugggaaaacucugcuaauuaaggccuaauuaaucggagccucuggacuuagugcaauaugggugacucccuucauuagcagggcuucuccucugaucuugucuggggaauucuaagcacacgcauacgccucugccuaaggaaugucggguagccucaauuagauuacaggaucaauuucauuucuccugauacuacccauucagucagccccugagguuccuaaaaugcuuccccauguuaauaaggcauuccagguacccaaaggccccagucagugaccuuugcucauccuggauguuccuacccucagucccccaaaucauuauaagcuuuggaucauccuaaguaaaauugaucugcccacugacagcuggucccgguguggagugugguucaucaccauauacauauucacaggguuucugaccccucccccuacccuacauguagucucugcuuccaggauagaaacuuaccuuccacuuuguugggcaggggguaaccaagggaaccuauuaacuauucaaagguuuccuuguggcuaauaaauuuuuacucauaacugaccauaguuaacuuggagcuugaaauuagagcacuucagaaagccuuuuuauucaaaugcaugauuaucacagucauagugaaagaccuguugagcuagucuugucguggcuguucccagccuuuauggaaaccaucuucccaggcauuuaagguagcugugauaggacacaugggagaacaccccagccauuaggcagguggcuuuauugagagugaggugacacaguggacacacugauaaugaguguccagaggccaggaagggcuagaccucccauuucgugagacagaaaagcuacaggagccuaggagaacuaaaacuugggccagcccaacaaagaggaugagaaaguagagagcucggcacucugauguacucugugcucuuagccuguuccugggaguuugacacucugauguacuccucuuaaccugucgcugcagguugggagagagauggaagacggagcauagucugagaaucagacuccuaagaacuacacgcacagcuuaucccuauaaaacuguaucuuuuucagauaccgugcuuaaucaaugaaagaaggcccaugacugcucuuagguauggcaggagagaggguuuauuguagaugugagggagaguauagccagacauaucuggagugguccagacugaaccagcccaugagaggagagaagaggagcaagaaagggcgggcggggagggguuggggcauaagaguaguaccugggaacccagagaccaggaagcuaaaaagacagcuagaaaaaauggcugaggauauacaggaauuagggaagcccagccccugggcuggagaguuuaagguaagggacaggauuugccagccaggaugacccuguaacugguagggacucugggagacuggccacuuugauauguuaaacaggcaaccucagccauuugugcugagguugagaccuaacagcaaacaucucuauuuuggggccuuaggggaacuuaaagaauaccugcuauagugaaaaggagaacuauuuacuagugggacaguugucuuagaagacagucuuacaggauugaguucccagguggacagccagcuagauccagggaggaagagaaugcuuugagucacacaguacaguucuaaggugauguugccuggaacuauugauacagcagaaacauggcccaagcauuguguggcgcuauagacaguccaaggagagccaagcucuccugguuuggcuugguuugcuauggugcccagcucugccaaguccaccuccagguugaacuuagcucccaggcagauggcucaucuacccucagcauugcugacacugaguccgugagugaaaucagaggauuuguaccuaggguauugaagggggugagaauuuccugacuacugggggugcaguggauucugcucaugaagcagguaggugcaggaggaacugggaagugaagugucuuagucuccaccaaacaguuuugguuuuuuuguuuuuuguuuuuuguuuuuuuacuuuagaaguucaguuaccuuggaauuuauuuaaacuaaagaaaaagucauguuucaugcaauacauacuugguucuuuaaauaacaauugugacaaacagcagaaagaauuagagaaugcugcacuugugauccauacaaaacaucaacaucuugggcuguauauaauuaaagaaacaucucacuuuucgaaauacuguaauagccaauauauagaggcaugccuuuaugugggcauaggaaugcaauuuagaaaaggaaaaaaaaaaucacacgggaacuagucaguuucuuuaaaaucacugagcaagaaaagcaacauugaacuuccauacugauuuuaugcagcuucuauacaguaccuugacuugaaaccaagagcuaaguuaagacucuccucuauuuuugguaaacaacaugguaaacuuagaugauguucccucuggauuuuaucugggaguggccuuuuuaauauuuauuuaaaagaggacagguuggggcuggugagauggcucaguggguaagagcacccgacugcucuuccgaagguccagaguucaaaucccagcaaccacaugguggcucacaaccauccguaacgagaucugacucccucuucuggagugucugaagacagcuacaauguacuuacauauaauaaauaaauaaaucuuuauaaaaaaaagauauaaaagaggacagguuuggcacuuuuauacugaugucaccaauguuacuauuucuugggaucucaggaagauucauauucuuuacagcugauacagcacgggcuggagcuccugcuaaaccagccucagauuucuccaguuuauuuugugcaucaauuugugugacaaucucauucauguuggucuccaauaacauuccccccaucaccauuucugcaagaauauuaugaaccuugucuacauggaauauuaaauccaguucacaaacauuuucagaacauuugucuaauguuuccacaaauacauagggcugguagaacuuggagagccucggcuucccgugguuguugaagaugaggauggccuugaucauggcugggccggggccaacccggugggcgcuggggccagggugggagcgggcucgagagccucgccuccaagugcuucgugccgcggcuuccaccaaacaguuuucacauauuaaaaaucagaaaucacccagacaguggcaggacugggaaaggggcuucagacacuacuucaugccucacauacauuuuuuuuccauagccccucauucaccaaaagcugucucuuagauuagucacagacuacacuuggcuucauuagauugauuugcauagaugacagaaacuagaaugacacuuugucaauaggaccuuacauuugauuuaugggucuugauaacaguuucuuucuuucucucuuucuuccucuuuuaucuuuagauuuauuuauguguaugaguguuuugcuuacauguauauuuguauacuguguguaugcccaaggucagaaggcuaggaguccucuggaauaggauuuauggaugguuaguaggcaucgucaagugggugcucggaaucaagccuuaucuccaaccacugggggccuuuguugaagaguccagcggcacguuuaacagccucuugugucuggaagcugagcuagacggggcuugcugcaggucggcuagagccuguuauguuugggagacuucccuuaccuccaaauguccugcggcuucugacauuuggugacagggugacauuccucauugacuugaaggcugaagacccuuaagcagauccacucuuguuuaccuggagaauauuguagacucugggucucuaaagcaaacauggguuccuuaaaugugugguggcuacugauuaagggaacauuauucucaaaugugacauugaagaaaaugcugccauuguaaccaguguucaauuacuucccaauaacggggaaaacaaacuauuuuuaacccucuacaaaaaaaauuauaucacaauuucugaauucuggaaagaccaaacagggagaaagaauaagaauucaucgucaaauccgucuuuuauguuugugaaaauauaguaaguauaucuucaagucauuaugagauccaaauagcauaaaggggaagggucuccuguuuaacacacagcacagaacacagauacaucaaccaacuaaaaaccugggucacucccgcccccauagcucauuuagguacacugguuucagcagugauacacuguucuggcugguuagcacuccccaggguuaaucuucuuuucaggguucuggaaaccucaguuaaauccccccagggggcugagggucagaacaaagcaaaauacaagaugggugggaauaacuuaaaugcccauuuucaaaucacaaaagaucugaugagaguuaauuauaaaagccauagcaauggagagguuagguugaacuggaguacaaagcacaaagcuuagggaaggcaucuguaaauaaugacgaaccuuaucuuccaaaaggaguaggaaguauaccuacuuauaaaguuaggagcagccaaccagaugggcuaguuggugaagaugcucacugcaaaccugacagccuguuguuauucccugggaucugcauaaugaaaagagagaacugaccucugaccuccaugugcacuccauggcacgcgcauauauaguaaguagucuuacagauaaaagaucagaugcagcaaaauagcucuaagacauauuuguggucugucaagcauaaaauuggagcaagaauuccaaagagggugaguugcuggucuagagucagccccacacaucugcucguugauccacuccaugacacagacacccagggaggcaaaccaucucuuuuugacaguuugcuguguucugucaccaauacaaucacaucguguggacacagcuauuuccagguccuguauuccuacaaaguagaacauacaaaauagacauugccaggaaauggcacagcuuuaggggcaaaauauuuuuaguuugauuugggaaaagcaaaaccccagaaguugucaggaaauuuugaauaccugguuaaaacaguaccauaguuacuaagaaauacuaaauagauauaauguccacauauuagacccauuaaucuagguagcuuaaggaagaacacauauaaggagaaugaaauaaaauguuugcuaguaauagacaggaaaguuagcuaucuccccccaaaauaaaguauuuucccaaaaauuuaccuaaguaugugaaccugaauuauuuaaauguuugaauuuaguagaagugcuucucucucucucucucucucucucucucucucucucucacacacacacacacacacacacacacacacacacacacacacuguugaaagcauuuuauagcauucacuaacuuaacuucuuagggcaagggucuagggaauuuguaguuuccccuguaucuccaaucugugacguauggccucauuugguggcauuucuucaugagagccaucauacaguggaggauaauggcugcuugagaaucccaggugaacugggcuucaaccagaauguucucauugcugcccagcagaagagaugguggaggccuggaugccuguguggcuauggcgugccucucacaggugcuccuuugaucuugaaagcauggcaccuagugucugaccuaggacagcuguuuauacaagcaaauaagacugugcucuucaaugcacucugaguuuaugcuaccacucuggcacuagaaacugccuuugaguuaaccuugacaucccaagaguaucccagcuugcaguagccaugagucuucaaauugaaggacaaaauucagugugcuacaauaaagaauaacuuacuuaaagauuaaauacagagaaacuaggacuuccuccaucccagauuauguauggcagguuagaagagucaggugugugugguggaggugggcuugauccaugaucaaagccuucacuucccagauguuucccuagggacuucuauuagagaaagauagagcagauacagguuucuugagguuacacugucaucuagaggggguguugaaccagggucagacagucaguguaggaaagaaagacacaucaggaugcaucuuagcaggguagucaccacaaggaggcuguguaagacagacgucuugagcccaaacucagauccuaggugagauuauagaacuagaaacagggauggggggggggguggcaguagagcccuguuucuuuauuuaaaacaaaacaaccaaacuguaagaauagauuccaaggcaauauguaguuuuaaauauuucccuuauguaggacaguggcaugcacacaugcaaaaaaaaaaaaaaaaaaaaaaaaaacagaguuagaguuuugauuccaaaaucucugucauggaucaggcaugauuaugguaguacaaaacugcauaucuacuucuuaguagcaugaaauuuuuauuugcuucaaacucaaagcagacaagccgaaagaucucucaauccagacucucuguuauuuucacaguggagacaagaucucuguaaacauccauccauuuagagagagcaccacacggucagagcaugaaaccaacagaagcuggcaccagacucaauagaauugaaaucagguuccuacugagacaccaucacucacagggucagucccuggauucuuuggcacaucccuaugucuccagggaugcacacaggacuccuguguucccuuuccuagauguggcagcaaggccaggucccuguaccuaccccaggagagacaaagccaccauccaucacucuguucagacugguguaaugggaggauccccucaugaaaacuguaggaaagggauagaaggagccaggguuuuagagagcagccuauuaguuuaucucacagguauuaugagggcacauggcagugggcuucuaggucaccaaagaagaugcagagguguauuauuuuugacucugagagcagggagucuugucagaacacgaaaggugugggggguggaggggagacuuaauuaucauuguuauuuuuauggugguacacgacucugguaaaguuuagcuuugucauagagaaucggcucccuauaagaucagaacagguauuauagccaucuauaauauuagauguguccuccugguccuuucucauaacacugagcaaaguuuucugauuauaauuagaucuuugcauuaugacuguuaccuugcaccguggcucucauuuggcagcaucggauuauugucauuggagagaaucaagcaccaaaacucacucagcuucuaugucuguucuugaaaucucauacacagacaaaguuauaugggcacgacucaaauucuuguggaguuauacugugaaaauacguaugaacacuuuaaauauuauuaacuuuguagcaccugggaauaauucauucaaguggcucucaguuaagacauccauacaaagaaaggucagguggccugucauuugugaaacgggcacugcaaagcccuccuggagagccguguucagcuguuuucuuguacuucgucauuguguguaauugacucugaugaguuguccuaugagucuccagccacgucaccuagagaaguuucugcugcucccccacagagcuugcugaugaccuacaaaggucagggggcuucuccugcccucagagcuucccaugagugagccuccuuccugagagaagcuggcaguggguagauagcagggaaagagcauguguguuuguugaagggccaguacacaagugucacacgugauacgaaacucaaacaggugugggguuguugaagcucagagcacuguggccggaggaaaggaaacacuggaggaggcagggccaugcaagggcuuggucagccucccagcuuggcuugaggaaacucugagcucagacuggcucugcugucaccauggugauugacuuacaaggcacggcguccaucaauucaaccauucuuuguucuuacggagcuaauaccaucuacaaaucgugaccuuguuuauuuucuuuuaaauauugaugggcagagauugaggcaggaugguagcuuucaaacuccugugguuuuucagcuaaaauacugaguucaccauguugcggauaaagccuuggacccaccuuuccaagacacagucucucugugaugcugaagacuuuggccaaagccugggaaagguucuagaaacacccacuaauugggggcccaguuuugguccucagcuuuucuucccaucacuuaacugaaggaagaaguuguaaggacacagaggauggguaagggcaaaaggagaugcagcuggagguuauagucuacaaaacgguuucuguuagggcugaagagauggcucagaaguaaagagcacuggcugcuccuccagaggcuccagguucuauuccccucacccacauggugacucauaaccaucucaaacuauaguuccagaagaucugacugacacccuuaccuguccccucuaaggguacaagauguacacauaagggacacagccaugcaugcaggcaaaauacauacauguuauauaaagugaaagauauuuuuauuaucaaguacaagauuuuuauguggggaagagagguggcucaggaaugaacaggacuugcugcccaccagaggacaguccuucaggcagcucauaauguaacuucagcgucagggauccaacauccugaguguucgugugcguacgcacauacacacacacacacacacacacacacaccccucuuuaaagaaauaguuuuguuuaugccucccagaaaggcaucccacugauuuugaggcauuuaaggucucucuguaaaacaccccauaaagugagcaauucugcuuagaugagcucuuugcaguguggcucuggccaccuguucagggggagaguucaccugucuuuccagcgucauaguuccaagucagcggccuuccagccuguggauuaggaugagccugcugguccccuuucaaaccacugcccaccaugugacccaggccuuuucucuaaguggcugaacuucuaaggccucuaauggaucccgcuuagauaaucaugggcuguaauccaggccuggaccuuguccaguccaaacauugcucaaauaaacucaaaguacaagccuguggaucuugaaaccaaggaaggacuacccugugccucaggagcaaagcuuagcagguacaguggccuagaaggugcucucauaugaucacacagugguucaaaccgauagauaaacugaaccaaacuuaaucaaauugcaguuucuaaguugggcagccagguucagaaaccugauccaggacucagcaggcaacaucuggggccagaagucagaagagacaucaccagccugaugggucuaguuuggcauuucccucaucuuaaaaaggccugaucaucugcccgccugccugccugccaaugacuggaaccugccgcugggcccagcugggacuguuuaauacaauauuaucacuaaagcuuuugcuguguuuagacacuaaauuauaguuuauaguguaaagacuacagguacugaggcauccuuagaccuaauuuucuaugacuuaacagcuaauuuauuaacaagcuaguuccucuccucuuccucagaagaaacuaggucccguuuauauagggcaucaaaugaccagaccaaacagccagacucccgcacauugcuuucucaucaaaggcuaguagagaacaaaauagaaaaugagaaaaauucuuagcaaaguuuuagagacuuagccuaaaaagccaaugaaagaugugucuuggucuggggugcacugcucugcugugggguucacaggcuuugcccugagcagaguaggucugcugggcauuucaggagacccuuaaaacugaaacaauuacuuuuuaagguacaggaaugacucuugcacugauauaaaaugaauauucggcauauucauuugugaaggaaucagaaagcccuuaucuccuauucaaaggagaauaaacagagcgggaagggagagggagggaggagauagagauagaauuaaugccaccccuaggcccugggcuguaagucaccugcuuaauucaaccuuccacuccccuuagucccauaaagccgaccugaugccaggagaacacgcgugacuuagagaagagcauguccuguuucucugcacacuggaagugugugugugugugugugugugugugugugugugugugugugugugugugugcgugcaagccacauacccuggacucgugaccaauggccauaguauacccauguuuuaccaaacucuuuccuuucagucugagaaaccaaguccauuggccacaauagaguucauggcuuucuucugguggccacccugucuuugucugugcaccucucacacucugugggccucagccugccuuuuaagaugauuuuuagauugucacgcauguugaaauggguuugcuaguaguuuccccacuggaggagugugccagucagcuucaguuaacuguuacagacuaccugagcuugcugucuuaugaagcuugggucaucagcuggccauguugcuuuguccucuggugaugaugcaucaugguaagagauugcagcagagcaaaacugcucauaauuuuguggcagggaagcagaacucuuuugugggggaggagaacucuucuagaacacacacacucauaccacacacacagaggacccccuuuccccacuguccuaaagaccaggccugugucuuaaaggucccaucaccuccaacaucagcauauauaagguuaucagaccuugaagacuuaaauuauagugucgcauagaucaguugaagcccuacuggguggacaucucgugcccauaaacagucaucuuacauguuauguaauuguuccuuguccuguugcuaugacaaaacacagaacagagcaaugucaggaaggaagaguucaucugggcucccagucuaagggugcugcccaucacgccggggugcacaaggcagcaggagcaugaggcagcugugagcauagcaucugcacucugggccagagagcuaugaacgcuggcgugccuugcuuccucuuuaugcagccuggccuccauccccuggcauggagcugccugcauuuaggucuuccagccgagguucacuuaacauaggcagugccucacagccuaguccaaagcuuggcuccauggugacucuuaagcccuaucaagcugccaaucaagaucaccuguugcguguuacacucagaucuuaccuccagcucugaguuuggcagcugccgacuuugcgaccauguuggcuuugucacacagcugccuguccugccauccuucagcagcuccaucucuuuaaaucacuuguagcaguaacagguaccaauaccugucauguucuuaggagaccgacugcuuggugaaugggaggagucacccuggauauaucuccaagucucucugugugccaugaccuguauagccagauaagugggugugcuggcuuucuuuguaagucauucucuaucuuugcucauuaucuggcuguggcaucuuuuaggacaaacgcaaaauguucccuaaaucuuaaccuucccaccagccaccaguggcaacuaagccuccagcuccuucacaguccccucaggcugguuuuauaccguguggguuuuuaaacagcugauggaguaggcaucacgugucaucucagugggacuuuagugguguuaacccagucacuuggaugucuuaacauuccuacuugauggccguccccuccuuuucuuuggagccaugucucuccaagcugcuugcuugcguuuaaaauugaggcuuugauuuuuuuauacacuucuuuuuuuauauguaucuuugccugcauuuauuucuguguacauaccacaugugugccuggggccuacaagguaaaaaagggcauaggacccccuggaacuggaguagcagagaaucuggguuccuggaaaagcaacuagugcucuuaaccaagggggcaucucccagucuuuuuuuuaacauuggguugucggagaggccagagauugacauuaggugucuuccuugacuccucucugccuuguauguagagacagggucuuucauuugugccuagagcucagugauucagcuuaucuaccuaccaacuugcucuggccaguaccucuggcuucugaccaaugggguuacagauggccacccaguauuugcuugguuuccuggagaucugaacucuaacccucacauuuucacaggugcucuacccucuaagccgucuccccugcccuucaaaagcauuuugaauuuccaguggacaauauugugccacccguugaauuuauucuguguuguucuuuucuauauugcugucagugggaacugcuuucuuaauauacuuuucugaucguucccuacuaauuuguagaaguauaacuguuuuuguguguugaucuuauuucuugaagccuucuugaauuuauuuacuucucgugguuauuuuuauugaaaagccagaaaaaaaaaaaacaaaaaaaaaccaacccuuguagaauccgaucugaggguggaagugguuuuacuauuugcuuuccaguuuuagucucuuuuauuucucugucuuaacugucuggcuggcgcagugguuuaguuuuuuagcauaacaguccaucuggggguuagaaacuaccccaaaaaggacccugggaaucgccaggcauaugcugacguggcugguauguaaacccauguggcacucuagacaauggaguuugugacugaagagaaccuguggugggcaggcgguaaggaauaugggguguguguguugggggcaguggggaggugcccagcauccaacaggguagagacagcuuguucccugcugcugugcccuggagcaaugcugucccuggccuguggcucccuggacugucccaccccugcugugucagagaugacaguaaaagccaguguagggucagccagaaucauguuggaugaguggagucucccauauccauccaggccuugaaucuagaaccaaucaggacagauguucuuuuacaguugcaucuggguuaucagaagugcggaaggggcugggcggugguggcgcacgccuuuaaucccagcacuuggaaggcagaggcaggcggauuucuaaguucgaggccagccuggucuacaaagugaguuccaggacagccagggcuauacagagaaacccugucucaaaaacaauaacaacaacaaaaaagugcagaagggguuaacaguaaaguauuacaggagguuagcuaaaagcaugggaaagugguucuguuaacgagcauccuugggguucuuccucugcauaucuuuuagauuuaucuucccucuguguucuucagucuccaucuuucccaaauguacagugucuagucuucaauguguccccuucgaggaguguccugucaucagugugguuucuccagucaagaaacaauugaggagcuagagagaugguucaguggauaagagcaccaacugcucuuccagagguccugaguuuaauucccagcaaccacaugguggcucacaaccaucuguaaugagaucugaugcccuuuuccgugugucuaaaggcagcuacaguguacucacauacauaaaauaaauaaaucuuuuuaaaaaggaaacaaaaaagcaaaugagacuccucacuucaguuacaaggguauuuuguauaguguaaauucauauuuuguguaaugcauaauguaaauucaaacacucccacggaauacacacugucugaaaggcagaaaauucugagaaacuuggagugcacucguguaucuaagcauauuuccauagcauuuacauuuucuguacaucggauuuucagggguuguuuuccuggguuuuuaauaaaaauaaccaauaauuaauaaccaauaauuaauuaauaacagaauaaauucaacaaggcuucaagaaauaagaucaacacauaaaaccagcuaugcuuguacagauaagucgugagcagucaggaaaggauacuaggaaagcaguugcagggacagcacuuacacucugaagugguggguaugugccuuugugugcgcgaguagaugacuaguuacuguucuuguccugggaggagcaagguuuaucuugagccccacuuugaaggacuggagcugggaagucaggagcuugaggaaacucagugcuuuugcucucaggaagcagaaagagaugagggcugguacucaguugguucuggucugcuuauucaccaucuagggaaucccucacagauaggcccagacauuagcuuccacguuucuuccacaguuuuggaaucgaccacccaaauuaaacauaacacuaacuaaaaauguugaaaauaucuuguuaggcaagcucugguaguacccauuaguacugaugaaggagaauugugagugccaagccagccugggcuacauggccccuugaacccuauauacugacacccugucucaauagcaaccaccacuacuaaguccaugccauuuucauaaaagcagauaguaguagcccaggaauccauacgaugugugacauuugcuggguccuccugaccacaaauaguaccguacaggagcgugucugaaacgaggacaugguugaccauaacuuaggaagaacagaccagucuuuagaguguccucucacuucuucauaacuuuaaagugugcacuuugagauuuccuguuguuuuuuuuuuccaagcgcuauaaaguucuuguguguuuaugcuuaaauguuuguguuuaagugauguaacuguucaaaaaacuuauuaaaguucauuuccguaggaaaaauauuucuuauauuuugacuguuuuuuguuccucucuuuugaaaucucuagccaacgagaacauuggucaugacaagcaugccaucugaguaaguacuuguuguuuugauaaugaucgauugcaaaauuuagccuuuucuuguauguacuguaggucuuugugccuuuaggccauccacagaacuggacuggguuacuuuuacucaguguaacuguuaugagguuagaagaucacuggaaauuaaaaauguaguuaagugugggcagucgagcaaaaagcuuuuuggguccuuuguguagcauuaggagauuuuguuuuuugcuuuccauuuugcuugcuuaauuccuaaugguucuguuugucuaccccucacccuaugaauguucaauaaacugagcagugcggggugaaacauuuccuuaccgaucuuaaaggaacacuguggugggaagcuuucuccaucuggucuaaagcagcuaucucugcaucuuguugaaggguuaauggccugcuggcguacucuuaucaucucccuuaaacacuuagcacaauaaagaacauccaacaaaaauauacaguacuauauuccuugcaaaggauuuucaaauuuguguuuaaaggggaaaaccacauuauauauacauacauaucaaucauaggacuuaagguuuuaagacucucaucaaaacacugguacacuucggugaaaacacccuugagaaagcauucaaggauagaacauuuucuguggugggccuuuuuucuugcccaagguauggaaacaaaagugccagugcuuuaaacacugucuaucauauauugcaaaggaggacuccucuuacuuuuauuaauaacuugugaugugccacagacacauuagucuacucuagaaauacugaauaugagcauaauaaaguccuugauuauucuguaaguuuaaaaaaaaaugauagccaguuauuuuucucauuaaaggauugaaaaagaaaaauuuuuguuuugggugcacagcccucagcucccuucucaucuuacacgucuuguguaucuuaaggagaccuuggacagucugauuccacaucugauuaacagggccauaaaaaagcaguuguucccaauuagcacauccaugagcugcugguagcugccaggcuuggaacagagaagaucagauauucugaagugaagcucuaaacuuaauccucucugagaugcuaacaagcacagagucuccagguugguugaggaggggccaucuugacccacucugcagaacccuaagauuagacguugauggaggucagcccuucucacagggaggcugaguccuugaagugcuguacgugggagauaagacacggagacaguccacaaacuuggagcucagcagccugcccacugugugagaggagaaaggcucuugucucugugacacagagcauagcacagccuaggaggccuugcucauaguuccugauucacugaggauuuccaaacuauucuggagcagggggccauggauaucagcaagcauacuguaacaggaagggaagaagcaacagauuagaacuaaaggccuguguaaggaugcuagaagaacauuuugaaaaccaaaaaaguguuccugccguuaagaaaaugacagguuaaggugcuagugagcuuuggaaauuaaagagauaauuugaguccuuucuuuuuuuaaugguuaaaaacugcaucugacaagugggauucuuguaagcaaagguucugcugcaagccuaaugaccugaguuccaucccaggaacgaacccuugugguagagagaaggaaacuaccaugacaguuguccuuugccugccacacaaaugucaugacacacaugcauacauguacaugcguacauacauacacacacacacaaaauaauauguguuuuagaagagcaugcacacacuggucaaguaugcacgaaguacauaaucugcuguacagacagaugguaggagccuggcacccagugccugagcuauuccuacauagcaugugccuguguggacaucauccguaggcgcuuagacuugaggugugaagugcucuuguuuccucaaaccccauguugcacugcaaccaaaaugaagccagacuuugagccucuguuucucugaugggcaugcagcauggcggcugacuguugacucucugguccacaggaagcagacccucaucauccagguggugagcacacugaaaggcuuuucauucgcacccgaggucugcgagaccaccacccacgugcugguagggaagucugcccguacccugaacgugcugaugggaauugcccgcggcugcuggauucuuucuuacgaauggguaagccuugcgguugucguuuguuuuaaaaugagguggucgcuagauacuuuugacccaaaguguugauaugaacagugguaccuacauacguuuauguggaccaaagugcacccuguaggcccuuaggugucccugagaacuugggaaguuauucuuccugcagccacacugagagucccucagagagggacgagcuagagaaaggcagaaacccuuaggauaaacucucagccuccggagaaaaugagaucagaacagacuuggacuaaaaacacaagcuggauuuucucacacgccagcaagugcugcuguguguuugacuaaggagcgaugugaacuaugcuugugauggcucagaagcccaaaaaagaaaaaagaaaacuccugagauuguuugcacagauggauuugcuuaggaggaaacauguuccucuaauccuguuuggacauguuucaccaagcacacaugggucuguaacaugauuugcucugcauuuaaggcaguccuuaaggaugcagcauccuuuucauaauugauaaauguugccguggucuaucagucagcguguuuguccucugauccugagccgaggggucacuuggaagcccaccagcucucugcuaaugggagcaacagcgcugcuugcuuacuugugcuaugaugacgcggcccaugguccuuucuccucacccaagaaugcacuacauuaauacuggguuaauuuaauccuguaggauuauacuaagaaaacaagcuacagauguccgccuaaggauggcucuagucucuuucccgugucauaacccacaggucucuguuacauaaagguuaacagggguugagaagaggcgagauugcuaaagugcuugcugcacaugaagaccuggguucaaaucccagggccccucccaaaacgccuggucugcuggcacacaggcuacaggcaggcagaugacuggggcugucaaccagccagccuagcaugauggaaagauagaucccaauugagggauggugucucagaaaacaagguggauggcuccugaggaaggggugaggcucaaccucugguguccgcacacaugugcacacacagugaaaaaugcagaaaggcuuaugagauuucuguuuaaaauuaugacaugcaaaagaaugaaaguuauguucuguucuguucugguuugguuugguuugguuugguuugguuugguuugguuugguuugguuugguuugguuugguuuuuuucaagacaggguuuuucuguauagguaggucugacuguccuagaacuguccuagaaccaggcuggccucaaacucagagauccgccugcuucugccucugagugcugggauuacaggcaugcacuaccaugccuaguugcaaugagucuuaaaagguaguguuuucagaggccaugguugcuuuaccuaguuacaucugaacacugccucugccugucugugaaaugccaccucaucacuaagcuucaguaacuggauucccuguuuuguuucuaacuaaauaugucuucagcacuucauccuucaaucccucuuccuuucauguuucaaaaggaaacauguuucucuauaaacauacguauccauacucacugcugugccagucuguucuccugggcguugagcugccaggagagaccagaugagggcuugggauacuuaaugucugcuuagagaaagacacuuguaggugaggggcacaggaaaggaacugcuggcauccccacuccauggcauaguuacagaagaguccagagcagagagaaagaggagccaacuggacauggcuaggggcucuguccuucaagagaagggagaauaggggaagagggagagagagaguaggggaagaaggaggaggaagagcacagagagggagcaagaggacagcaagagauagagggagacugugggaguacugagaauacaggaugaguaucuagagcaggaaggagccuacggcguggcuuugaaauuuuaacacccuacuugggaauagggacuaaaggacccucagucuuugcuccaucuuuaucccuuuagaagguuagcccaugaucauuguggcagggagcagacaggcauggcacugggccaguagcugggggcuuauauuaugauucccagauaucggauggagagagagagagagagagagagacagagacagacagacaccgugagccugccauggguguuugaaaccucaaugccugccccuagagacacacccacucuaacaaggccacaccuccugcuucucacccaguuccacuaauggcaccaagcauucaaacacaggauccucuggggccauucucuuucaaacugccguuguugcuacccgccggucaccauaguuuuauauaagagcagugcauaaaguaagucaucaucauggaacuccuucccauccuacagcucccauaagcuuuccauccucucugcugugcuggucccugggucuugcagaguguguuguagaagcccagcacccaaguuucuguguuagcuauugccuucccugugcaaggcagaccaguccaaggagucuuuagaaggugauuugaccucacccagcuuaacacuguuagcaaauuccucacuagagccugugacuuaacagcuguggauuucugcccuggguuacagaaccagauuugaauuucuucucauggagcaggccucauaucccauccaauacuugggcucucucagagccuucaacuaccgugucccagcaagcagucccuauuugguuugagagcacuauucuuggggggggggggcugcaucucacgcaugaugaaauugauugcugugccagcagccccuagcccagcacuguguagcacagugucugccacaucaagcagaugucugucccuguaacugacagcugccagguccucuccuucucuaucacggcugcagcguuccuuaauguugagggaauggggguuugguuugguuuuuuguuuuuuuccuucuuuuuuaaauuauuuuuuaauuuuauguuuaugaguaugcuguagcuaucaucagauacaacauaagaggguaucagauccuauuacagaugguugugagccaccgugugguugcucggaauugaacucaggaccuuuguaagugcuggugcucuuacugcugagccaucucuccagcucuugagguuauacguuuuuguauuggauccuugagagauggcauggaccuugcugucagaggaccucaaacucugcgguccuuccucuaacccaaucucuagugcaguugggggauucuuaaaauauucccuuuggcuaguaugagaaacuuagcuccaaggaaaacauuucugagaauguuuuuauuucaggguuuguguaguguucucgggaaaucucugugaaagaccauuguagcaguccuucaaagucagauggcugccuguggccagucagucgcaaaaacucugauuuuguaaaccacuuugguaugaauuuuugccuaaucuuuauuuccccauuugagcacauggcuagugaugccuguguguucacagagcacuaauuucccugguguucacucugaugucuggaaagacaguuauccuuguuuuucugacuucaugacagaacugccuggcagauaaguaggagagaaagccgugccuggcccugcucuaccugggagacccggaguaccacaucagaaaaccagcugaucugacagagacuccaucuggacucagggucuguuaaacauacugcuugcuguaggagucaucagacacccgucaccuugucgugacuugcuuaguaugucucuuagucucugacuccucugcagccuggcucugccuuuucgucacuuguggucacuaagaggcuagcagagcauccugugacccagccccucauccagcucugucuccagucaaaaacagccuggcagccacagagaauucaaccccuuuucauauuauacagaugucaucucuaaacaucucacaaacaaagcuugauaaaagccuuuuaaaaguuaaaucugcuguaaauccaaauauuucuacaggaucuuaaggagcucacuauaaauaaucaagugcuuccugauucaggaagaacaaaaugaguuucugcccuagaaugaugugggcaagcccaggcuuucuccccuuggcucgcugguaucaagaauggcgucaacuguauagagcagaguaugucacucauguaugcucugcaccacuugcuuccaaguccuucccagugcucaucguagagccuaagccagguccagccagaaccagaucugccucccgcuuggucaguaccuuacacucccuuccaaagacugcucagaagucagcaucaagaaacgaccucucguugugaaccuuacauuaauagauucuaaggauaacuuuuuaggcaaaucacaguugcucuaucacauucacauccagacuuucugcuuuaucuccuccugcuccucuggugggcagcuguguacagucuuggguuagcuuggccauacccggcaaguagggacaucaaacucccagggaucugaguggccucaauccagagagauuucaucccugcuauugguuauggcaugagagccugcaggcuacagagcacuuaauaugugcccacucgcugguuucuucagagcacuuugcaacauagaaacugcacuucuaaacacaugugcagaugaggaugcagugcuugucugacuugaacaugggucuuugagacacccuuggucaaggcauugucccaaggcaauggccacaaucaguuaguuaucuuaccauaucccugccuuauagauucuuucuacagggguagaacuguagagucugucugguuuugucccuugugguauacccgagaacuuuuuccacagggaacuggcuauggaccacuacauaaggauucugucuggagcccuuuccuaauccucugucaucauuuuugucccucuggcaagauccuagaguccuuuucccacacuggaggcacaaacugccccaagaacauauuaaaaacacaaccacacgauucccuggaaaauucgggccuuggcacuuaccuugaugagaacagugggaaaacguaucugggagggaugaggggggggcucuggagucaaggccguuuuuuucccagagagaagacaccaugagccaccagcaccacaggcuucaccauggacaaaaagcucugcuaccacugucucuuucuuuaaggugaucaagggccaaguguagcuucaaggucacuaugagaaaggaugggaagccgcucagacuaggagguagaaggcuuuugucuuccuguccuccgcuacaaauggguuucggggaggccagagcagaagcagaguaaccagcagcaguggguaggauaauccagagagaaacccccguggccaugacaagggcugcaauagugcggguagguuagagagagcuugucugcagccuuuggaacagauuucauaaugcguguuguaugggaguagagggaacaaggugacucagccuacaguuuuacuggugacagccaugcaguucuacauaggaauagugagggagaaaagcauggacgggccaaggucagguauuaaggagagagagagagagagagagagagagagagagagagagagagagagagagagagagagagagagagagcacaugcaugcgcaugcaugugugaguuggguauaauaaagugucaugggaugauuauguaaugaagaucaagaauaagaguaggccuuaggcuggaccaacccuaaggaacccagaaagauggacaggagcaagcaaggauaugguguugcacauuguaaacacacucacuuuuucacacuagggaaaaaguccuggauuacaguuaguuuuaaaguauaaguuucugugucaggcaaauaguuucaaagaauuaaagcaagaaucaguaaaugggggcacucagccucacucagcuugucugugacauaaucgagggcucaggugccaacacuguuucuccuuugccacuaaaucuggaugcuggaucaaauaucuccuuaugaaggagaacucugggacaucaccuccacguucaaguggaacccaaguucagagcucacuuuuagaaaauguguuagugagcuagagauggcucagcauuaggagcacaggaugcucuuguagaggacacggguuaaggucccagcaccuacacagugguucccaaccaucugugacuccaguuccacgcaguccagugcccucuucuugugucugcuggcaccagguaugcacauggcacacauauguacauguaguggauuacuuacaacacaagagauaacauuucagauagcauccucaccuuccuuuguugcuucuuuguugcaaguucucaaauaauuucuuacuccugcuccugucucauuguaccaggauuuaaccuugagccccaugguugccauggagugcucagcuauauccacaacccaaucucugauggcuugaucagucuuacuguugguaauagcauggaauauuuuauccguuggcaugcgauggaaaauucauccauaauuuggcguaauuggaacuuuccaacagcugucuuucgccaucugucauucagauccuucccagugaugccgggaggcugucugcuguccacacuuucaggguuucugaacuuuauccccaagcuaaagcaggcugccagggagcauuguacuugaacuaugcuaguccgaccugaagugcugcugcagcggaggagacuugagcgcccacaucagcuccggggaaagcugauagagaaacacguggcuuucaaaggcauuuguacuacuuuucaaaacuauaguugaccacuucacucacuuuccugugugauacauuucaugccugauucuuacagugcauucagagaaaauaaguguuaugaaagaaaaaaauaauaauaacaucggucauccuuuugcuagagaagaaggaaggggccccauguuagcuuguccauguaguuagagcagccuggagugugcuucuaguaacccucugccuuugcgcuuuccagcuggcuuuguuuucugcaugucucugcugcuguguuaacauucacaccuaauaauuuaucaagcucuggccaucuacagccauauacaacuuuagggaccuuugcuccagcacgccucugccaggaugugaccaccagucaugaugcucaagguuacagaggcuacagagcucuguccucagcauugccuccucuucugcccaaacugccacagaguaccaccccaagcaagcaacgacagcaucgccccaauguuccaggagucauuuucccuugaguuuuguugaguaacaacagaacaauagaaagagcauacauacaugcaguggauuccacucauagaguuuuuaguuuuugagcacuccugacuuuuuggcaguugaagcaaaauauugacuucaguuguguaacuaaaacaguauuuugcuuccuacccuuugccaugcaaccauucucccauuaaaccacaccccucaggacccuuaaagcgaacuuuuguuacaugacuuagagguccucauacucuucuuggcacccaaucagacauggggcccagugccuauuuucugaaugauuaaaugaaaagaugcauggccuauuucuuuuauaaauuggagaacuuuagguucugucacacccuaaguugccaaacuaccuauguaauuaguaucucucuuauuuaaauucaguaaaguaugugcuaauuuuuagaaaguaggauaaacuccaguguuucccuuaguaacuguagcuuuuagaucguugccuuguuggucacaguaacuugugcuuugguuucauacugugaagugauguuucugcuauuuauuuuaguuacauuggaauuuguuauaguuauuucuuuguuuuuauucugauaaggaaaguacgugcucaugcuauuuauaaagauguuuggauuugacauccaaguccaguggugaaaugccgggucacccuggucacugcauagcuuguuugaaaaguggcuaugacugagcaguuuagucucuggcucucagagaaacucauuuuuauuuuagugaaguggaaaggaccaggucuagcccaagugcucuauuccauagagcucagcucuugugagacugcuaagggauaugcaggcauuuccacaugugguuggauacuccuggaaucccagcaugcaggaggcaagaggcagaaaggagccugauuugugugcaacucaaaccaugugaggcccugucucaaaaagucacacacucugucuguacuagcuaguuuuaugucagcuugacacuagcuagaguugucugaaaggagggcaccucaauugagaaaauguucccuaaaaucugucuguagggcauuuucuuaauuaauuauugaugcggaagggcccagcucauugugggugguacugccacuggaaugguggaccuggacucucuaagaaaacaaugaacaaaccaugaauagcaaaccagugagcagcagccuuccauggccucugugucaucuccugccucaagguuuuagcccugguuggauuccuguccugacuuccuucaguaguagacugcaauguagaaguauaaaccagauaaacuuuuuucuccaacuugcuuuugaugaugguguuuuaucacaacaauaacaauaucacuaacuaagaaacaugcaaaaaaaaaaaaaaaaaauauauauauauauauaugucaguaugggaauuuaucuagugucucucucucucucucucucucucuccccauuaauaucuucuuaaaaggagagaaucacuuauuuuggauaguguguuguaugucuuccgugucuuaaauaucacuaaacuuuuaauuuccuccuuuuuuuuuuuuuuuuuuuuuuguaauaacaguguggugguuugaaaaaaaaauaauggccucauagacuuguguuugaauacugcaucccuggaugguagaacuguuuggggaagauuaggagguguggucuuuuuugaggaaucgugccacugagggcaggcuuugagguuucacaacacuuaacaccauuuccagcggaccucucucugcuuccuguuuguggaucaggaugugagcucucaguuacugccuuaacacuauggcuuccugccacgcuguccgcgcucccacgacaaugauacacuuccucugggacugcaaaccccaaauaaaacuccuucuacagauuguccugggugugguuuuuaucacagcaauugaacaguuucuaccugaagugggguguuaccgugacaggcccaaucaugcuguuguuuggagcgauacagaagacuuugaggggaaaaauagcuggguaguggcaugcaugcuuuucgucucagcacucaggaggcagaagcaugcagaucucugaauucaaggccagccuggucuacagggugaguucuaggacagccaggguuauccugucuucaaaaaaaauaaaaaauaaaauuaaaauaaggaagaggaggaagaagaugaugaugacacagaugauggugacaucugaggugauaaggaugacaacuacuuugggacuuucagaguagaaaaucaguugaacgcacaguucucuuauguaguucaccauccaugcugagagcaacacagacuaccaaggcuccgcucaaguuguuucagagggaacaguccucuccaacuggguuagaggucauucuugcgaugcuuugugguaaagacuguggcugguuucugcccuuguccuaagaaucugaggcuuagcuaaaaaggacuaaguucuuugguggaggagauuucaagucaaguguguggaccuauuugggcagggugggaaggcguggccucauuagaggaaguaugucacacgccugccauucccagggaucucuuucugccucucacuguggaucaagaugugaguuuccagaugcugcaggagcugccugacgucauuccuuuuuuccaucuucaugaacuucugacucugcaagcucacaugcacucgaagucaccuuguucauggaacaauagcaauagaaaaguaccugguacagacagaugagaaggugcugcaugaaaucuagguucugauaagggugacaguggucuagauuaucuccacagauacccauaugcccagugucaugacuagacauuggauaggaaggcacuggaaaccaauuaggcaugcugggucuggagaagagcuguuucccaguugugucggugccguaguuaggguuucuauugcugcagugaaacaccaugaccaaaauguugcggaagaaaggguuuauuugacuuacuugcagaucacaaaccagcacuguuaagaagucagggcaggaacccaagcaggacuggaaccuggaagcaggagcugacucagaagccauggaggggugcugcuuacuggcuuacuucccauggcuugcucagccugcuuucuuguaaaacccaagaccacagcucagggauagcaccacccacaaugggcugagcccuaccccuacccccauugaucacuaauugauaaaaugucuuacagcuggaucucauggagacauuuucucaacuaaggcuccuugcucucugaugacuccagcuagugucgaguugauacacaaagcccgccaguaugcucaguuaccuguuucccaggugaucugcaucugccaguucuauuggucagcacaagcaucugugagaauugguggccugcaaaccuuuaauaagugguucauaguccaggggauucaugcucacaguuugugagucuuggguucaacacuuccacagucucugacucacauuaguuccagaggugaccuaggggcucaucuuuauucucagaaaggcuccaacuuucacaugauagucugcaaauggauggguuucguacuaaccuuauucacagccacuguguccuuggggaagcagugacauuccaagcccuggcuugcuaaucuauagcaggucaagacuaucuauauggugucagcaaauauuagcauguaguguuaucaugcaaagaaccuugacacuuuucugaagcuuuauuaaagucauaauugauaaaaacucuaacaaccuuucacaaggucacaggccagaugauguuuuaaugauaucuccaucauagacgacuccauggagaugaagucuggucagucguugucaggauggagcuagagagaagacagggaagacuuugugggcauagacaggcuuuugucacaguuuauguuuugaucgaggcaaaggcaggcagaucucugagaauucaaggccagccugaucuguaugucaaaucacugauacacagugagacccugucaccagaaggaaacagggaaggaagugcuggagggauggcucagugcuuaagagcacuggcuacuugaccagcggacucagggucgauucccagcacccacacugacucacacccaucucaagcuccuguuccacacgaucucauaccuccuucuggguuguccuaagaugcugcacacacauggugcacagacauguaggcaaagcacuuauauguacaaaauuuuaacaugaguauugaauaugucuauauacaaguuuuuuucaguaagcuuugaaacuagaguggggguaacaggacagugugggagaacugcaugcauuuggaaauauuugcuauuauuaaaaacuugcaugugaaaaccuguuccaauguggcaggcacugcaucuacuaaauggucuuacuuguaccuuuuaaaacaacuuauggaauuauagaaagcauuucuugguguugugagauaggguggaaaugcauagggauagcuuacuuuggaacuaauauuauugccuugaaacucugccaauucaaguugggcucuuuggaagaccagaccuccuguuuucuggcuccaaagugcguaggacauaaguaaccauuuacuuugucauuagaauuaaacuguuggucugucucucugugucucuaucccccugucuccaucuuuuccuccucccuccucucucucucccuccccacuucccucuguaaugacauggguacacuguuccacuaacugccugguuacucuuccauuguuagaaaugggugacacacauuauauaugugaaggauuaacuagcuugcccuuugucccaggcugucugcuuucucuguguuuaaucaguucuuuauacugccuaucugggggagaaccacaaacuuuauucauuacccugaaacagcuaaaaugauguacauaguccaguuuguccuaacuuucauuguuugagaaaaaucaccauaaucauuaagacugaggcucuaugagaucugauggggagauauuuauaauuugaaauuuaugguuuuaacaaguaacaauguacuuuuauuguucuugaaaauacugugcauguuucuguacauuaaaccauaguugcugggggaagauauguagguagaugguggcagagacugcccugccacuguucuggucaaaguaaauaaaagaccauguacgucucaguccuugcucugucuguugacaaaguggacaugaagcagaccuugaauacuauaaaguuaauuagguuccaguggauuaagucugugacucgagucuucauuggcuguuucaugcagcuuauaagaaacucccucuugcuccuuucuccauaggacucuaaaggagcucauagugccauagcagcccaggcuggccuucagauccucuguagcuggugaugaucuuagucaacuucugaugcuccugccuccaccucccgccacacaugucgauguugugcuagggacugucccuagaccucccugaaugcuaggcaaccacucaaccaacucaggcuccauccucaacccguaaaguugaaucuuuaacagaagagcuggauaucuguucuucccuaaaccagccccaaaauagaggucagggaggcugguuaucugaacugugaaaugaacucaguuuuuuuuauaguacaguuacaguaaguuuggucaucaaaaucuguucauaaauguuucagcaugaccuacagcagugcugucaagugaguugaaucggcuucacguuguauuucaugucagcacuuaaucauugccgaguggagcuuuuagcuuucuaaagcccaacuugaaaaagucugucuuucagauuaguucuuacugucacacaggccgauccaccaucacuuucaauuaaaauaauuugcuguuguuuuuucuuuaaaaacguuucuugagaaguuagacauuaaggaagcuuugcuuaugaucucugcuugggagacacuuuuugaguaaagauuguuuguccuugagguauuguaaggcguuaaagaaacagaacugggagccaugaaaagaguuccgugaaaaaaagugcuuccugguaaguaagccuggccaccugggcucaguccccgggauccaccagguguccucuaaucaugguguuugcagacuugugagugcauaaguguacaggaauacacaugaacaccauuugaaaaucguggcuccuaaacucucuaauguacuaagauccauagaauuucugcaaguuucuugauuuucuugaauugaugauuucaauuguuagcgucccuaacagucuucaccaaguuucuauagaagcaucuaaacuaacauucaucuuucauaugucuacacaucagagagccuuuaauuccagugucuuugagaugcuacugugaccuccuugguugcucugccucucucagaacucaggcucacaggcaaauguuugauccaugcgucccacugccaugucaccagaauucccuuuuuguuuguuucgucugauuucccauacuguggcugcuuugcaguuggggauggggguggggccgaggauacagcuauacccaacacagaaggaacagaauguauuaauguagccuggcuggaguccuggguccccuguaaaugaaaaggugacaaaggccaaaucucgguauucccgugcuuuuuuuuuccucgauaaguggccccagaaagacugcccaguacccacccgagggcacuguuccuguguccagggugacaucuguguacagguuccuuccgagcuccguugcccuuagaaaagccguggcuucacccucaucuugccucagcaaaugagcugcuccuccagccugcccucuuccugcaaguugccuucaccccacuuucugcagcuuuugggaaccugaagaaggauuuaaauauuccauuccgucuccagacacuugaguuucugccuuccccaguuggccaccauucuuccaucugcucugcauuucccaugcauuuaguuccgcugucucuucuguguaccgcuucccuccuucauuccccggugaagcuaaauguacgcuuaguuuacucuaacagccagauuucagcugcauuuccuucaugauauguaauggucaucuucacuugcuucuucuuuuuuugucuuuuaauuuuuuuuauuggguauuuuccucauuuauauuuccaaugccaucccagaaguccuccauacacuccccuacccacccacucccacuucuuggccguggcauuccccuguacugaggcauauaaaguuugcgcgaccaaugggccucucuuuccacugauggccggcuaggccaucuucugauacauaugcagcuagagacaugagcuccgggguacugguuaguucauauuguuguuccaccuauaggguugcagaucccuugcuucuaauaacagcaccacucucuagcuucuccgacugcagccaaauuuccucacacugcccaagagaauuauaaaaaugugugcaacaagaagagacuuggaggguauggagggaugacucagugguuaagagcacugucugcuauuccagaggacugggguuugacucccagcacccacaugguagcuuacaaccauccauaacuauagucccauaugauucagugcccucuucaggugugcagacguacaugcagacaaacacccauauguaugcauguauauguguauguguauguauauguauaaauaagucuuuugaagagagagggagagaaagagacuuggcucgcugauauagcaugaacuacauagccuguaugaagagacaucaucaucuuacuacaucuaagaauaaagcaagaaaacuguuccucugauagguucaucagcaaagugcggguuuuaggagugauggucacauggcaacacuaccauuucuguuauccaguuuguguaaugccucuccuguguucaaguccugugcaggguguugugcuuaaacugagguggguccuggagguaacuucccccaccaaggcucacauacacacaggauguaguccucacucacaaccccaucccuugcuggauuuagucucucagcuguuuucgucuuauguaguauuuucugggaaaugugugugguuggguaagauuauuucacaaacccaccugaaauccuagaaaacagacuuccacuauuuugaauauugcacugagcuaaagauggguuuggcuaauguaagggcuugugccagaaaacauuuguaaacucuaaaagaccaccaaggagccgauuuugauacaaucuuuacucaagcucaagcuugggccacaccaccuucucugagccagcagaacaggagggggcugaauacuugguuucaggcaagcaguggguaucuagcuugguccuuaucugacugggggaccaauauggccuuuaacauaauuagcugcuguugggagccaaaccauaaacuuaacuucugcuuuccuccuaguuggugcuuguuaggaagcaaagugucuaggggugcagauuuguuggggaauaaccuugaaacuggugcuagacguaggucuuguugggggggggggggggcggaccuagaaacugguguuaagaaccagccuguuaauuugaguucaaccuuaggucagguucucuaagauagagucugaacccaaaagauuugguuucucaggcuagaauacaaaguuguuuuucuguauuauugagucugugauuuuagugaaaucaaaucuauguuuucugcuaccuuuaugcaacaucuauuuuaaagaaauuaaauguauccauuugcuuagcaaaauuguacuguaagugccuuacaauuuuauuuucuuaacauuuaaaaaggagcaaagucauggagcacgaauguuccccacgaacuuguuuagguucaguugacauuuuaauguguacugaauuggaacuugagugccacacacauuucuauggcugacuccuggccucuagcuggugugccgaauuucccaccgcaggauucuaccauugcugcaugcugacaugaacuuaauguugaaaccacauuuuaucuccugggcugauuauacaaggucgaggagacccacauauccacagcguuaucucuaaaggauagauagcacugggaggccgauagcgguaaggggagggaacacuguguaauauggauggcuuuaacccacacaguaauugaacuuauuaagaucuuucuccuuucucuccuccuucccuccgcuuaucuuccucccuccaauggcauuugggcaauaaaaguuaggagaaaacagaaagacaguuagaugacaaagcauccguggccacaggaaucuaauugaaacugauguuuucuuugagugggguuccugggagcauaacuugcuguuucccauguucuccucuacucucauggacugucuugagcucaacagccucauagauaugacuucugacucucaggucuugugcuuguccccaccccuccccucucuggccaucccccacaguccuacccuaccaccaccucugccagcccggcaccagaaccacaaaugcaccucacccacuuuugacacaggcucuagaguucacagucagcucccucugcuuucacaacuugcacuuuaccaacugagccaucuccccagcccucgagcccuuccuuccuuccuuccuuccuuccuuccuuccuuccuuccuuccuuccucuuuuuuuuuuaagcucguaaaacuguggaauguucauggaagauucuaaagggcaauuuaaaacuuagauuucuagcacacagcaugucacauaaaaagcaggauaguguuuuaaguauuugauuucauuaggaugcuguuagaacugucaacuugacaggaugugaaauuaccuacaagcuuccagcugcugccuugauuuuccagccuugaacugggagccucagcagccuucucugcuucuuacauugcuucuguuggguaucagguguuggguauuggugggugaagccaccaagcugggcacuggccuccauuucuagccacacugggguguuuuucuuaagauguuugcuaauggcuggagcaggcacugugaagugucccaaagugcucuggcuuuuguguggcugauuucagacccuuggagcucaucgaugcuaggcuuuuagggggguugcuuuugcucugaucaaaagugacuccaaccuacuccccaacagucuaaucaauccgugacugauauucucugugugcuauguuucuuuuagguacuguugucuuuagaguugggccacuggauuucugaggagccuuuugaacucucugaaaccuucccugcagcuccgguaagucaaugcuguccgacagugguaaaagcaacauggucgucuaggaaacuguuaggaucauaaacuuggcaccauagguuaagagaggucuuauucagacaaaaaggauguuaucccaaaaaugaauggcaucuguuuauuuauuugugacaucacaagugaaaacuugaggaaaacacuugaaaagugccgugagaaaugucaccuugaagaguguccccuaagccaggcaguccagcacacaggaaacagaauuggguggauugcugcaagcuugcugcugucccgggcuggagagugagaccuuuccucaaaaaaaggauuuuuaaaacuaauuaaucaugaaagccuauagggcugugccacucuuaaggcuaaugcuaauacagauaaaccugauaaauauaaaagcuguggucugccagcauugugaugggcugugcagcucuuaagguuaaugcuaauacagauaaaaccaauagguauaaaagcuguggccugccaggauugugauguagucuuuauuuugauaucuuuccuaugcuccacuuuaugaacucucaauuauuuuaaauauuugcuaacugaauucuaacuucucaaauaauuaagguuugacuggcagcaggggcuguacagaagucagcuuucauuuccaaacauguugauugguuugagauaguuaaucugaaaagaugagucucugaaagacagugguuguucuggcuguccccugugcucuuguguagcuguccaagugggccugcacagggaccagcaggaagcugaccucugaccccagucgcucgcucaucuagcccaucucauuguuucuguuuucauuucaagauuacuguuuugauuuccuuucagcuuuguaaauguuuucuuaagaacagaaaaaaaaaauuccucccaguaauucuguuuauuuaaaauacuguguaaggagcugaagaguaaaguggaaaccguacuucuucccguucucugagcuaagagagaagguguaacucugagcagcgcuauuagccuccaucuuccugcauccacugcugccugcccuuccugggugaccaucuuugaccguuucccaccucagcucuugcuguuauggucagucuagaaacaugcugcugccuucaagcucuggauuguuugggguuuuguuuuuuuuuuuuuuuuuguuuuguuuuuuuuggugucacauauuuuaacuggguacaaagccauguuggcccugucgacauuuccuaaauguaauaauagaaacaguggucaaaaggcagggacagaguucuucacucuggaguuagcuggcaggaagugaacguggcagaggagaagagcgccuuggcuaccccgagucuguggauugaccagagaacacaccaaggcugugugaaaggagauggguuaaggcguugguucucagccugugggcagagaccuuuuggggucacauaucagcuauccugcaaucagauacuuacaucacuauucauaacaguagcaaacuuacgggagugaaauaacuuuauggcugggugucacuacaacaugaggaacuguguuacagugucucagcauacgaagguugagaaccuuugcauuauagaaauaaacuuaaaaaauagcaccuagaaaggaaggauggacagauggauggauggauggacagacagacaaggaaggcuacaggagaaauugcacuagugcucuguacaaguguucauugcugcagaggccacucugcaggcuuaggaggguuagaacagaaggaguuaagguuugacaauucuaagcauaaaguuguguucugaaacuuuuucuagggguaucugguuacauugugagcaggacauuuuggcuuuacagucugaaacacuuucagcuuguuaguggauauuaaaaauguuacugaggcaaacuaauuuuuucuaaaaguuaauucagagaauuauggcuuuguagaugucccagguagggugauuuuccuccacuauaaauuaaguuuuagcuucauuuucuaaaauauuaucuuguuaaauuagggagcacaucucuaggcuagagcacuuugcucaguggcgaaguucuucuucuugaaacagcauuuucgucauuaacagcagucuuccuuguuacaagacacgggagugugugugucugugugugugugucugugugugugugugucuguguguguguaugugagaccaaagaacaaaaucguaaauauuaucguaaaaauuaaacauaaucaccucaacuaauaacuuauauuuaauuacuaaaaauaccuucauauuuaacagccaggaagaaaacaaaauaguacagucuccgcauucaccaacauggcgcuuauuuggugguuauuccagagaugugggcauuuuugccauauaguaaauaguagccagccauuaaaaacuaagccaucaagauagguaaauguguuguuuucaaaugaacauguaaagcacccaagaggaaaacaaugaaugugugcuucuccagaugauaaccugugcccaccacuuagaagucccuggauacuggcugccacagugcgaggacacggccuugucauugugacagccgagcugugaauguauucacucuagaaaccgugcuuagaggaauguggucccaagauuuaucugcaccaucuaaguguucuguuuuccaguuauuuacugcugaacucccacggaacauucuucccugugacagagucugcacgcuguccuucugauccucagccacaaccuucccagaaguguuucuccagacugcagugccuuugguugguuagcggugcaggcuuaagugaugcgcuucagucugguacacacagacccuccccacccccaggagcacuuccugauguggaaaggggcugcuaugcauuggugucucucagugccuuggaguuaaucuuuggaugcagcaaguucuucugguaguguaggcaggcauuuagaaaucugcuggccggaucaucaugguuguggccuugagcgaguagccggaccccuuccaguaguaccacuugauaccguuaaacuuauuuguauucuguuuuuguggguaguacuguccauucaaguuggaaggaccacaugcgucaaaccaccagccugugaaagcgaaacacagaagcaauuaggacuggguagcugcagcuugucugcaggacuuagcugggcacacacacacacacaccccaugguguggaaagagccacauugauuuguuacuccauaaacacagacugcacaccagugcaaucccaguacugugguagcaugaguucuuacacaugcccuagcugcuuugugcagaacccuugcuacaugaagaaaugucggucagugcugugugaaaagcuaucauccacagugcauuguggggugaagacauggugagacugcuggcagauguggguagaaggugggccaagugguucccaucccccuccaucauguauauuuguuuggaacagaagccaagugugucuagcucucuggggagcuagggaaaaaggaaccuuaacacuacaaagugugguacugagggagagucaggcagcaguaaggaucuuucccguuguagcuccggagucuacccacaaauaggagcauggcaggcagugggauucaccauaugaaggagaaaccuagacaauguacuaaucugaauuuaucuuuaagccucaagugggagagacacugguuguauaguauuuguuucuuuuuaaauccagaaaacaacaacgaguagacaguaaagaaugugggugaaacaccaauucugaggccaccugggcacuaccacuuggagacaccccuagcuguugauucugagaaaugggaauguauaaaaagagccuguguuguguaaaacccuagggcuggagagaaaugucaguuacagaucugccuuagccuuugggcaccauuggagucauugcuccugugcacuuuuucacgggccaccuucccuaugggccagcccauggcuuggaacuuggccucuuacaagccagaccuccccacuuucccuccccuggcugcuugccuccucccaagucucucccagcuccauucucagcccuuaaaucuugagcuggguaaauaaaugaauuguguccuugguugggaagcagcucuccugcucucuggaauagcagcacacggguggucugagaacagucagccucuccagagaggucuaagugugggaacgaacagcaagccggcucgggaucaggggugcuguggccccagaaccuaccccuaccccggcuguuauguggcuuuaaagacagcuguuacagugagaugagaguccagcccccuuuacagcaguucacugggguucucuccuuugaauaauuacagcuaauagagaaaacucaugccaccaaguggccaaucugcuaccccaagaauccaggaucugccagagagugggaccuaauucuuucaugaaaucucaauuucuaaauuucauuucaugaauauauccucuuguuacuguugcugcacgaauucuuuacugaagagcaggcauuguucaagcuuagaucuuuuacuugucuuagaagcuuuuauucauauaauuuaauuaauuuuauuuauuucugguguggagaucagagaauugcaaggagcaguucucacauuuggccaugaggaacccagggaucaaacucagaugucuggcuugacggcaagcauguuuacccacagagccaucucacagguuugagauagagucucaucaaaccuugaacucauggauucagcuagacugacaggcaagccagccccagcacuggaauuguugcacaccacauauucaaccuuuguacaagagugcuacagaccugaacaugcacauggcaggcaccuuacccacugagcugucuuccccagcccacuuucuugcuauauguaagcaucauugcaugaaagagacagcugaaaagcccugggcuggauauuaaacagaaacaaagcaguauggagccaaacccuucucuuuucaucuggucagugagccacuuaauguccccucgcucacucccaagcauccugagaguacacugucacccuugugacaauuccagcuccaugcugugcuuucaugucacacuugaacuaaaaggaggcccaaccaaugaacugggaggcagauggcuuguguucuuacggaaguaaggcuguucauugucaggcaugcauuccagucggagcuuacacugccagucgucuaugcuaggcagcugcuucuugccaauucaaauaggaagagucgccuuaccuccugagagcaucugggaacacuugcagaugcauuugucauuguccgaauccuuugugcuaaaaucacuuccugguuggcugaugcuacuuauuuugcccgcgguccccgugaguccuguaaggugaauccuggaacgugcaaaggaaaaaauaaaaauuguaacuggcuaggauuguugauugacuguaguggaaaauuucucauggugaagaauuccauucuacagagugcacuggggccagucaguacacuccagugcccacuccguacaaaauacuuuguacugguauaaacaggaaccaacuuaucaucaaacccucugacaaagagggagggauguuuucaugacaacuucaacacauauugccugcaccagcaucagcagaccuuaauggggccuuguaauucauuaucccucugcauucagaugaacagaaggcaucugcagaacaaaggggcuucucacagacccccuccccgcccccaaccaccacagucccuggggaauggcuacuagagugaccagauacccugucuauagucugaagggguagaaguugggguggagaggcuagaaggcaaggagugggugaggaguuugggguagccccuauagcugcuuugccuugauucuggacacugguauaauaaaccugucugaccucagaaaggaaguaaaugucagugcccagaccccugaucauggaccacacuguuagacuguugccaaagugugguccucagcagccaacugugccaacaaggagaaucugaaggucaggauaagcauaaucgcuuuaauuacuauuuuauuuuguuuuguuuuuaaggcaggguuauauacacuguagcuuaagcuggccuggaacucacuaagcagccucgguugaccuugaacuugugauaguccaccugccucagccucccaagugcugggguuacagucauggauggccaugcccaaucagaacauauaauucucuaaaaugucacaaacugccaguggucagauguuucgagucagaccagagcugggucucacauaauagggugacguaaggauguccuuuugguguuuuggcaugccaguaaccagcucuggcaaacuaucaugcugaauccccaagagcucaugcaauguagauacaggagucucuggaaauccuacauggugacuaccaaguguccuuugagcccccaaguguucucuucuuuguaaagcucucuguccuugccauccaccaccuugggaagauucacuugucaguaucucaugugggaacaggcagaggagagggcgagaccacugucccaggcccuggcacaugucuuuacagugagugcucacggcagcccuaggacagcagcugcaguguguggagaacuaguccuugugugcuugggaaccugaaauaguuuucuuucugacauuuaccccccuuuacacccccuccaccccaccccaccacaccccaccccaccccaccccuccccgccaagguuugucuuccuuuucagucucuugucuucuuugaaaggucaguucucaggggacucacuaaauguccugcaaaggcaaguaaugucagagagaaaucuauuuuuauuagucucucuuugaaagguuauucaaucuuagagccuuuuggaggccuaccagacaaaaguacaugcuuucaaaucuguuauuaagaacagccuugaguuggccaugucauugcucauaccuacaauccuagcauuugagggguggaggcaggaggaucagauguuugacgucaucuuuggcuacguagcaauuucaagacucccucgggcuacacgagacccugucuugggaaucaagagaaagaaggagaaugggguggcagggugugagcaggcaggcaggcagacacaugucuuccuuggugccccuuucucaugcacuccuugguuuccugcuuguucuuggagggaagcacgucccaaucugaagcuuggcuuacucggcacuuacucaggcguuacuuccagaguacuuagccguauuagcauccucuuaauuaguguagcaaguuuuuauggauuauuauuguuuuacauuuccaaguaaacuaagccucaaaaaccaguggggauuuuuuuuguuguuguuguuuuuucaaauagcaucuucaaaauauguuugcauuuccaaaagaaccuuagcuuacacuauuuuuauaaugucauuguggaaggguaaggacccauguaguaaaaucuccuuauguaaacaggcuaauucuucaucucuguguuucuuucuuuaaaaaaauuaauuccucuauuguagauuccuaacugcugccaguuaagaaaauauuuagcuuggagauagcacaauggagaccacugugccuugggauccauugacuucuggacucuggaguccagcaagaccgucugggugcugggguccugcuugucuucccaugcacccccuccagggaauccugaucuuucuaaaaggucaccgaccauuccagugucacaacaggcucugucugcuuugaaaacagcuucggaggaaucgacacccacugucugugaaaagcagacuguuccuggcagcaugucgcucucaggucagaccccaggcucugagcuggcuucccugugcuguccacugugaccucccuaggacaccagcccaggauguuauagucaagcuucuucuccacggggccugggcgccacugagaucgggguggcacugugggccaugacuuuguuucuggagggccuguugugcgucaucuguccucuguggcuucucgggccugcucugugcucuguggacacaagcagugggugcccacauuguuuggaugccugcgucccgcugggcucacacaccugcuucuuuggugccacugucaugagcuuccugaccaaugcucccgugggaccuggauuugaguguagcaccguguagagagauuccagcaccucagccauggcuuucauuguccacacagaaagccaaguccuugguguucuccucccuuacagcgcuuuccagccagcgggugagugugcugucaggcucgcccaugcgcuuggaacaugugagauuacugucagcagccagauggggaugagcugacauccaaggaggugcugugacucagauguguguucugcaucuuaauuugggacugagcacaacuguuagcuguguuugaccuucaaaacacgggcuaacuuuuaauuuaauaucuuagguaagaagacaguaugccccaggugucugucucuccuuacauaccguaucuaucaaacggcuaucucauuacacacggccugucgagaagccucuccacucagaacacacacaggaaagcaacagaugcaaaacugcccucccaguuuucugcacauugucuaaccacagguagaaagcuaugaucugccugucugucucagugaucuaucuguucaucuuucaguccuagggacugguuuagggucuugaccaugcuaggcaagugcuacuccagugaguuaacaucucuagccaaagcuaggauuuugaaacuagaggaacugagagacggugaugcccccgagaagcagcaguuccgugugacccagucguggcuccaugacaacuugcuuaccuguaguuggacucuucaccagcgagguagaagugaucauacagcgaaugcgccucguugccuucccaguccuucagcuggaucuuaagcacguagcggugcugaccggucagcugggagacaaacucauugcccagccaguacucucccagagggcucccgaagcccugcaaccgagagaguagagucagucagcuguuuguucuuguguuuggaauccaucaccuuaguaccaucuuaggugagaggaugguacuccuagcccugggcuguacaaaugcaaggucuugcacacagaaaaagauuuuguuuuuuuuuuauuuaauuuugagagauagaagaggagucguaaauacaugccaccaugggccugcgaugucaccagcaccguggauguuagcuguacucucugccuuauuuggggcaggcuucccuuucaccacuguguuauucuaagaccagcuggcccacaggggucuggggagucacuuguccuugucuccccuugucauaggauuacagaugagagcuaauguguucagccuuauacggguucuggggauucgaaaucaaguccccacacuugcccagcaaggaucuuaugccagcacaggaaauagauuuucuuuaagucaguuuuaaggaccugagcuguucuuagaaauauaacuguuacauagcuaaagcuacugggauaaccaugaacagagaugcuguuguugggaacagccagaaccaaccuggguaccaugaaccguauccauaguagugacauuuaugcuguggaagccugacaacagagcagcuuacccagugugcucuguauuacguuucaguuccuuugacuacgauguuuuuuaagagagagagagaaacggcugggcacaaagaaucauaucauaaguaacuucuucagaagccaucggucaguucugaauuuguguuaauucaaaguucugaagaacuugggaaauuggcuuucccaaaggaaaguacuuucuuaucuuagugcauacuuccuuaccucuuuguauucuuuccacguccucuggaaguccacacugccaucuucucgguguuggaugacuguccacccuccuccacccacguccaugucacaguaggccugcaggagaagcacacaguuacugcaggcugaacauuggugacccaggcugcuacagcagcgguguguucccagggggcucugugguaaccaggggagugaaucguugcugucaggucuuuagagugauuuuaaaaugaugaugauucacaagcagucagaccacaugagucacuggugaaaaggaacuuccugcucuggcuguagagucccacgccauaauuguuuuugagagugauucccuguaccugggaaacuggcagauucuccucaaaucccauaucuuuagaaaaacacagacuuguguucauagcacugacaacccucgaugcuggcuacacccuguguccauuagcuacaagguaccaaacucccgccauguuuuccugcuguugggcuuccuuugugcgcagagaaagccaguuucuccugccugugagggccuggggggagggguuucugcagcgccagcaccaugugacccagcuugaccaggcagcucugacacugguuugauuucaggcuucuacauacuuccuuuguugccugcggcauuuuuccccaguauuucugcuuuuaaacugccucaguggucuuuaaauuuuuugccuggaacacaaaauucuuugggcuugaauguuuaauuucaacucagcuggaguuuuauuguaaaaauuaaaacccccugaaaauaagauuauauaaauacuuuaugagauuacaguagaaccaaaagaaaaaaaguuuuccagaaaauaagauaauuucccuaaagcauacaugguagaaauauuaggcuucccaaccaguugugaauauucuuccuuuguucggugccauggucuuuggagaccuaggaggaccauuuuugcaggguuaacuuuaauauagcugcucuguguuugugauuuagagcuaaaagagccacaugagccucucacccuauuucuucauauugccuauaaggaacuaaacccaaaggaauccauacuguccuccauguuguuguccucugucggacaugguccuugagaccaucaguggacugcuuuacugagaggccucucuccaccauuauucuacccccacuccaaagguccuggccuccuguuucccuccgcagugacuuggguuuagaaaggccugguggcaugaaauagaaucacuguguccucgguguaacuauucaaaaacacaugacagacuugcuggaguucugguuaucacaggacagauuugcugaaggaacccccaguugucacaguguauaaagggcugguuucuguaguuaaccaguuugacucucuugugcgcaacuugucagauaucucacacaaguuaccugccaugucacaucacucuagagaugauugauuugacacagguucauuuggucagucacagggccaaaaggugagaggaauuugaauauggucuccuugauuccugugucauaucuuuuccauggcagcaugcuacucaaaacagagaaauuugaaccuuuugauaggcgggcagauuaccacugaagucaguucaugaggaauccuucaucuuauuugccugugaucaaccagaugaccagugcugcaccguuuuacacagugucuuauaaaaaccucacguggggcacuaggguaaggaccccauggcuaugcaaacacauuaacuccccagcauccugaguggcuuguugguaaaugggaagaaauguuuguagugagcccacccucguucuaauaucugauuccuuaguguuaaaaucuucacagugcacuuaguugccugaugguauuuaaagcaggcuuuuuuccugccuagaggaucauuuuaucuugugggagucaaaagcaagagucccaacguugagggucacugcuacuauauaaauaaauuacaugaaccauguuucuauucucuuugaauccauuagggaccaugacaaaguuacuagaacauucucagaauacuuuguccagcuuuuuaagaaguggagaacaaagcauuugugagaaacagagaauuaugguucacuggguugugaaauuugcaaaaagagauaauauucuuguagaggauccacacggucaggagaugcucaguaaaaauacugacaaggaucagaacaagaucugaaaggcagcggcagccaggccagggcacggccacuuccaugacagcaaaccugggggcacugagugcuuuugauuugcaugccugugcuuggcacaaggacccaaggccuuaagcuguucagcaagugacgcuugaguuaagugcuaugcuccagcuucaggccuuggagaaaugaauaaauaacagacgcccauggcacugagagucuugugcugagcagucuggggagggaaacaguugugcuucuaacuagcaaagcacaugccugugcugcucacggacgcccuaugcaguguguagccugcguacauauacagaaaccuaauguaaaugccauguuuacuggauuauuaaacugaucaaauguaaagcugccauacugaagccuuugaucuaauuccuuagaauuagauggccaugcccacugugaccucuugugcaggcuucauguaucauuaugccagggccaucuuugguacugucacacccuggaagaugggguaaugggccaguaacauaaagaucacgcugucuuuuauagaaccucaagucuggagggaaguuuagaaguaacaauacaauacagcccaguuauguuaauuuuuaaaucuuuauuagugggguggggggagguuaggucgaguaugagcaugcaugggugugaaggggaagcaugcaaguaggggucaggacaauucuucccuuccaccuugugacccaggagucacacugaggucaccgggcuuacauggcaaucacagucacccacuaggcuaccucaccacguguagaccaggcauuuuagaaaagaacucaagguuuugaacgacuuacuauuccuggccauguaaauggauuucuuuuuacugagaauaucuaaagggauuauaaaucuuucuauaaccgugaccuagacacaugauccagagcacuggaucuuuacaucuccgucaaacugugaggguaccaugaugucuggcaggaagagcguucccagagcaguguaacuaugugacagcauggucccagauccacaguguuugcagccucugcuccuccugucccuguuaucaccaggccaagaacauggcaggcaucuagugacagacaccauaaugcaaagaccugucugugcuggcaagcugcguagcagacaguggagacccucagucugcgguugcuagauuucugucugcagcaagcuguacggcuucuccccuccucccagugcucugcuucuacguaaccagggacauuaacugauugucaagguugguuuaaagcagcaugagugaauuauauuucuuuggaaaauauuauucugaagagcacaauauuuguuuuuaauucauaaucaaaguguauguuacuguuucaaauuccacaucuuuaaacucuaaagcgcauggacuuuucuuugauaccauguuaaauucuggagauaauaccgaguucaaaaagaugcuacuuccaggagccucuggaaauuucuacuuugacacagcuucccaugcauguuuggagcuggcggcauccugguguaaagcaggauagacacuaaagguccuggagcugcgugcucugcucagcccucaggcaguuuaaagaaagaguggccaguaggaccaaagaaguccaucagagcaauaaaaguauucuugcuuugugauuuucuuaaaaaaaaaaaaaaaaaaaaaaaaaaaaguuucacucugcuaaguauguuucuaucuacuaucugcuaaguacguucuaaucuacguuucuaugaugaaaagggaaaugugugcagaucagggccuccugaacaguuguguuggguguggucucagugagcucucuccaaaaugaaguauaacuguugcuuaguaaaaugaucaaaagacaagcucugguuaauccagccucaguuuggagaagauauauucauuaaaauuaaugauauaucagaaacucgggggaaacaccugagugugugcaucauuucuacaggacauguguguuggggaaguuagagcugcagaccaucugcucagcaucuguguucuguacucggcaaugucagagcccucagugugagccugggaagagcacgaggcauggaugcugaggggcuccuuggcccaugcagugauacagcagagcccccacagcugucaugggucauccuuaccuugaucuccucuguggaguuggggaaggucaguguguagaugccacugguggugaguccugacuugaagauuuccgcacagucucugaaggugguuugcucuucuuuacggauagcaaccgagcucuuggcuguguuuaaaaagcagcaggcauugaaaugggguuuuugaguagagagagauaccuguuauucaggacauagacauuuguucucauguaagcaagacagacucaauaaucuugaagcauguuugcugucaguuuggaaaauuaguacaaauagcucuugcuaacucuguguguguguguguguguguguguguguguguguguguguguguguguacauguguauguguacacguguaccaugguguagauguggcaguuaggggacaauuugcaggagucaguucuccuuacaccauguuaguccuagggauuuaaacauugaacauugguuuuugguugccagcaccuuuauccacugagccaucuugcccgcaucuuacucccuuuuaaaaccaaccguguguaacgugaguacuucauaaugagcugcaauaaaccacuccuuuaaaauauuuccuucuugacuagacuugggcaaacauuguaaaagaacaaagggagaccccuaauucccuccacuaucacccuaggucccuuugacgguuucccaccgaaguuggaauggacacauggacauuccuuguaugucugaggcuuaagucuuuaaucuuuuguagaguauuaaaugaaggucugaaaagugcgcucgguguuaggucacaguacuugcugagcaagccugaggucuaaaguuuuuaugguuagcacccauauaaaaaucuucaauguggcagcacacaccaguaacccuagugcuuggggcuaggagacaggauuacuagagcuuguuagcugucagcccagcucugguucaaugagagacucagaagacacuaggcaucuucuccuggccucugccugcaugcccaggcacacauacaucuccacaggcaccagacuauacauaauccaguaccaaaugacagacuuaguguucucugguguugaguagcugugacaugagagucuguaccuuuguggaagcacaauaccuacuaaucuauauguuuaaacucuuuaagucuagacaauaaauucccuccagauucuaauucugccguuacuguuucaacuuccuguucuucccaccgccacccaacccacccaucccacaccucucaagcaccaaauaaggggacaucgugaaauaaaccacaguaagaaugaggucaaagccaguuaggaaaaauccuacagauaaacaucacaaaguuaguauuacaucuuuaauuaaugacugaaaaaucucaucuucccuccuucaccccccaggaaguaaaagaagcuaacaagucaaaauuguggugaggaaggcuaaacaucuuucaggguauggccagcaaugggaacuggugccuccucgguaccaaccauggcccagacaugggcagugggggccucucacuuaugugucaagccuucccauggacccagggcagugugcccauuugaaagccaaaggcagaaagauugacuauggcuuccuaacuuguggcuuccaucugagugaugagggaacuaacucaagaugagaacucugcagccuugaaucaccacuguccuuugggguuggggacauagcugucgguacaaggcuuacucugcagucugaguucuagaacucacaucaaaaauacaaagccagauauggccacgcagcccuauguucucagugaucaggauauggagaugagcagauccguguggcuccucauggagcucuaggacagcaguaggaggcuuugucucuacagccaaaaugaauggcaccuaaggacagacaccggccucuagacacacacguuuauacaugugccuaugaccaugcacccaaacugggucaguccuuggugauaaguauuuaguauaauacauggccuucccucuucccccuucccccgccccuuucucuuugaccccucagugcuugggccucugcugagacucuuguacuucagacggagcacccaagacaggccguguuggaguguugagguuucccugaccguaguucaucggcaggaggagcacuacucacaguugggugaugacaucauggucagcaagcuguugacggucuccauuaggucaugcugcugcuucugaaggagcgaguuguugaccguggcugucaccagcuucuucuccagcucgucaaugacagagcucugcuuggacaccagcaccuggagcucguccuucugcuccuucauggacuguagcugcucgcugugcuugcccuccauguccagaacuuucuguucuaggaagcuuacgggggaagggguuuguaagugaagggcgcuccgcaugaacgucucaagccaagugcaugauaaaaucucacccuuuccaaagccaguaagucccuuucucuguuccccggacuucugugguguuugguuaaaacacaguauaaagugggaagauuuagggacuggacacacuggcugcucuaguagaagaccuggcuucaguuuccaguagccuuauggucucucacaacuacuuauaacuccauguucugauauauaguguugaacguagcuacuuccauaaucccaguucuagaggauccgaugcccuguugcaaccucuccaggaaccaaacacacacaugaugcucauaccuaugugcaagcaaaagccucuacacagaaaggaagcuuuaaaacaaagaaacagcaaagacaaacuuuuuguaaguaggaagauuucucauggcccaaugaaaccuuucagauuaccaaggugagcuauuuaggucugcucgugcaaguggguaaaccugacggaguaugcaguggggccuguucaggagugcacuggcccuaggccauauacugugccagccacagcuucuggggagguggcauuauuccaagccccgcuuucagacugcuuuucuugaguaugagccgcgaguuugaaguagaccuuuggguucuguguuaccuuucuccuaaaauauuuacauuuuaauaugaaucaucauaauggcaacuacgcucucgauaccaugugccagauauuauucuaugauggaggugcaugcaauccucuggcucuaugauauuaagugacuuacucaguuguguauugguucccucaucuguaaacuggguuaauauuauccacugcaaaaggcugguccagggaauaagugcauguaaaaguauaaacagacuggugguugacagcuaagacguauuauuuauuaucaguaucaauauuacugucucgcguucaaggaaaaaaaaugaacaaaaauacaauuuagacacaauaaaucacaugccuacagacacacccagguaucuggugccagaucuuucuuacucuaaacuccauguuguuuguuuguuuguuugugguuuuggguuuggguuuggguuuggguugguuuauuugaauccauuuuuuccucuggggaguguagccagccugucucuuauagugggugcucaaugccuacaacccgagcaagccccuugaaaagcugauuaaauuuuucuugauaaagucaugcuauauaaguaccaaaaaguuuuauuaauguuguuauaguuauuucuaauccuaugguaaagauuuauaaagaugcauuaccacucacagauucaguuaagaguaucaugauuuuuaacuggaaauuauuucuguauauuaaacuagagaaaacaauuccaagugcauaggauuacaguagugugaggcguuuaagacugugaacuacuucuaggaacagacuccugcaguaaaggccuacggcagcugcccuuguccgugggaugaaugaaagaguggagaaccugacugugaaccuuuccucuugguacaugcacagaacuaguggcugcuucgugcuucauggcccugguacugagcccagcguuuguuaguuauuucuaaaaggaaagagacugaugaaaugaagcgagcacaguaaacguaucuucaacccgagauucuaaaggugcuguaguguugauuuggagggaaauguagaucacaauaaauauuugugguuuugcuugaaucuauaaagaaagcaauuuuacuuugaagaaauuuugaauauuguuggaaaaccaucuguggaauguggaaugccccauauuuuuuccccagucauauuuuuaaaaaucuuggacuggucagaauugaaggcaggaaacacccaucaagagaucuaacgucaucaaggaacuuucaugacauuuuugacaaggaaaccguauuauuccagcccaugucuguaacaaaagaaaagacaguuucugcagcuuguaagacucuuguuccuuccgugugguucuugugcugauggguuuuuauggcaucaagcuuuguguacccguccccaggaaggcagcuccaacgagcggugccucggggacauuuucuuuucuuuuaacaguucagguuguucagcgcugcugaucccgaguuguuagauauguguggcaaggugcuuuuauggagaaacuccgggauuuaaucauaaacucaaagugacuguaauuauugaaaaggcacauuacuuauugauccacgucaguuaaacugggagaacugugaaggacuuaagaaaggggcggaaugccugaauuacuagaaaccauagcaggcugguuacacugauugguaacacuaaucucuauagcaaagcaccuugcuuuacacagcaaucggggcaagucuugcgaugaauuuuaaaauguagcagaagguccuguguauuucaaagcaauucccuuguguagcaaauucaguuucuaccauggguauaaaauaaggagcacgaguugaacuuuucuggggaaaaaggcaaauaccaacaguggauauaguuaacccuugacggccacuagcuuugcgucuguggauauaaucauacuagacuuaaaguacuugaggagugcauccaugcuaaacguguacccucuuuuuuguuauuacucccuagauaauacagcagaauuuugagcacaguuguuacgucaucuuuuuauuaucuguaagcaacauagaggcaguuuaaacuauaagaaggauuaaguaagcuauggggccauacugucccaucuuauauaaggcacauaaguauccauggacacuagucuccaaaguggauuauagauucaagccccuaugcauccugaaugaugggagaguuuacagagaagacauuggguggcgugguagguauauugacaugauuucaaagccucgggaagaaauguguucaaaaaaugagccgugccucguuucugagaggcuguaagaguuaccaccagcauccacaggagaccugccaaguggagauaagauuguuuacaucucaguuaccaucuugaguucucaucucuuaccgugcagaagggaaauuuaaaauaggaaaggaaacuguucagauaagaaaaaacaaucuauuugcuuuuccaucuccuaaauaaaagugaggguaaaccugagguuacccagagaacacaaagaauaaugcaguugaguuguugauuaacucugaggaugaugugagcccaucuucauccccuuucuggauaaagagagaggugugcuguuuagaccauucuccaugucagacgcagucucgauugaaaacaaggaaagaagccccugguacauuguaaaacuacucuccaguguccccuaguagagugaagauggggggaaaaaaguuugcacuuguauagauuaucuugaagguuuuuaaauauuuaaauuucaaugcaauuaaguuucacauaauuaacuuuuccuuuugguuuaucauaagcuuuuaaagguauuuacuggugcgugcaugcaagugagugaaugugggaggggguggcagggauagacacguuccacugaggcacgugaaggucagcgggcaguuugguggaauugguucucuccuuccgaguuuauguguguucugggaauugaacucagguugucaggcuugucugaccagcacuuuuaccugcugagcugucucuccaggccucaccauaaguuauaaaaaggaaguaugacccaacagagaagagacuguucccgcuuuccuagugugguucaucucacaagagacaagauccccacuaggcguggugggugugcuucuaaucccagcccuagaaauacagaagcaggaauaucucuugaguccaaggauaaccuggucuguauaaguuucaggcaagcuggcaguccacagugagagcccccaaccaaaggccaagaaauaugauugcaggcaauguuacuucacagcccagcuaguauuugguguagauuaaaccucauaauguugaggcaauuuggaagaugccugacagagucuuuuuuuuuuuuuuacuuguguuaucuucuuuuuuuuaaauuuuuuauuagguauuuuccucauuuacauuuccaaugcuaucccaaaagucccccauaccccccccacuccccuacccacccacucccacuucuuccccuguacugaggcauauaaaguuugcacgaccaaagggccucucuucccacugauggccaacuaggccaucuucugauacauaugcagcuagagacacgagcuccgggggguacugguuaguucauauuguuauuccaccuauaggguuagcuccuggguacuuucucuagcuccuccauugggggcccugugauccugacagagucuuuaaaggccuagaaugagaaacaaaauucaggacuaaucaggaauuuggguucuuuugagacauucucuccaaauucucuccuugccucuuguucucagggcuucugacccauauaugcuccaggcaaaugggucauucuagggaaaccagcuuagagucuagucacacgagguaagcugugugucuggaaaggugacagcauuauuaccuguucuuauuuuguagcuuguuuauuucacuggucugauccaaaaucugcuuuuccaauuuguugguagaaauagaauguuggagaagcugcagcucgagucuugucgucugguuuaguaccugcauauauaacaaacaggauuacugucugucauccugaguggugugauguaaucuugguuggugugauguaacggugugauguaauuugaugagugugacguaugcccucacucuugauucagucaucaaagugaucagaaaacauauuacucaguagcccaacugccuugucuugacgugguuuuucuuaucuuauaccauaaaaaucauaauucucccucauaauucucccucauuuccaccccaccccccacuuccuccccaaacacagccucuuccaacucuuuucuucuaauauccagccagguccaaauagugccacccauuggaguacagguguaguggccgugcacugcagugugggugaucuuacagugcccacgcaguuuaaagaaagaaaagaaggauccugucuucccagcagccagcggcugccagagcuccucagugagggaggggccuagagagcuuggacauggcaagcuuuuuaugcccauaaaaaaacacacccaacuauguuaucuuuuaaaucucuuuacagucaauaguaaaugagaaaauccuuuugaaguaaauaaggucgggaaaacauaguaucaagacauacauuauguuucuccuguaauauuuuacuguuuuauguaauguaacagauggggauguuaaauaaacaucuuaugaaucaaaaguuauagauaaauuuuaaaaauugucucagccuggcaagaugguucugcaaauacaagcacuugccaccaaacccggugaccuaaguucccuccccagaauagaaccagcuccugcaaauuguccuuugaccuacacacacacacacacacaccauguacaugugcaaaccaaauaaacuuaauaauuuuuuaaguuugugaaauaauuuuguuuuguucagaaauaucuuucugucaguggacaaagugacaaagugacauggguccuugugugaaaguaaaagcuaagagcuagccugucaucucccagcugauacccacuugguaagccuuuucuuucuucugaucuauuuuucuuguucccacuuugaaagcccuucuugccaauuaggggauaaugcaaugucaauauccaguggaagccaguacuccccauuguguggcucuuuggugccuggcugccucccagcaggaagaaucagcuacucacauccuuguguggugucacucaggaugugauaucaccuguuaauggaagucugacucguugcccagcaaccagggaccuugaaaaagaaucauuguuuguggggguccuuguccucaacacagcccuggccugucucaccaugcaggugcccagcaugucugguccuugucaagccuggcugaggucauaguagagcgcuucuggaaaugagcagaggccccgagagcaaagccaccaguacaucuuuggccccugcuuucucucuucagacauucaauuccaguuuauucuuuaaagaaugggacggccugguguccugagaauccaugagaauuauaggaugaggacagauuuggaaagagguagagaaagaugccaauggaaacccgcuugguuuaggaucgauguguguaaguaagaggggagagagggcgguguguauguggaggcacaugugugcuagucagaggguacuguuaggacuugguucucucucucugucucauugagcaggguuucucuuccucugcagugcuaucuguucugggcuagccggccuucccaguccucuggacagcucugucucugccacccagccuguuuuacaugggcugggggcaucauguuugagugaccagcgcuuuuaccucugagccaucucacuggccuucacguggcuuuucugagggauaaaccuuaggguucuguaugcuaacuuguucuggucagguaauggcugcaaggucucagaccuccggcuauguauggugucuaauaauggcacccugacagucuagacuucuuuugcauauggccagagguguucauguucuaguuuaaaccuauuccaugucauccguaagugagcggcgguugccgucaccuggauugcgagccuacgucagccucuccguguccuuccuggggcucacccguguugaccuguuuauuuggacccugcagcuguuuucucuccaucccuggccuguuuuccuguuagccucagucauaggaugucuaacuucauaguagcacuuuuuaaauccugugaucuuacacaggauguuacaaagguuuacauaguuguucuguguccuaacauuuuauugcuuguaucagaaaaaaaacaagaaaugcugcauuguccuuacuggaucuguuggaacagcaugauagccaguuaugucaaaagcuguggaaugucacuuaaccauuacuacuuuauuuuaucacuuggcuugauacauggauuguuuucuuucuaaccuauuauaucccuucauguuaacauuuuuuaacaaggaggauuaaaucuuggugccuugugaacuguggaaaacguguuucuucauauuguuccuaaaugccugauguuguugaaagaugauaaccaaauaauuuccuuacucuguuuuccauggcacguuuuaaucuacuguuuucucuauaaaaucaggcuuuagagaggcucuggaaggucguugucaccaugcuggccuugucucgggcuuuaaaaccugugguuucauguauacgagaccuguugucuuacgcugaaaucuagcacuugguccucuuagcuaaagcagcugaugcggcgcugaauacuggggugguuuacagugcggacccucuuguuuuuaaaggauuaauauaccuccgagcacgauaauacuaacuucugaagcuucuacgaaguaugaucugaucagggcucaggaagccaaccuacaggaaacugaacaccugaccagauucacucucccuuggggcucuuggcucuggagcaugcccugucugugccauugcaggcugccacccugcucugucacuacuuccguuaugaauccauuccauaaacaggaaucuaggguuagauuuaagaacaaaguuuccagaucucugcuucaugguuucuaguuuucaaauauagagagcagaacuuggacaugaagaauauuaucuagagucuagaagaggccaauaaagcaaaggaaacuuuucuuggaguauuaaguuguggauaacaugcaaacagauagaagggcccugauagaauaaauuaaacuuagccacagcugugaaaaugaaaacccguuggcuucucaaaguccuaacuguucuuuaacccuguggugcugaagccaaucccuuccuccacagccagugucuguagcuuuccauugucagacuguacagccagccacaggcacaugguguguuagcugcuguacccagggguuucgccucccacuuacuugggcuuccacaucagucaguuuccgaguuugugcugcugucugguucagcaagcugguuccaaucucuaucaucacagcugucugguucugcaccacauucuguuggaucuccaccaucuccuucuucauguuguccugaauguaauucuccagcuaggaaggagcacaugacggucauuagucauauggcuagaagccugguuccuaaauauuugucauuugccuucuuaucuaaaacauuauuuauuuacaguuuaguaagguggcucugugccagaggcacucgcucuguugcuugacccuuggccuuuuggacacugauuuccuugaauguaagguagcagcauuuccaggaggucaguugacgaccucaagggggaggccaugccccugcaccauuguggaugcgcuacucagcgcuuaaauauuuguuuuucuucuuaaaaugguaauccaguaaugaaagcuauuaauugucccaaauuauagcucaagaacaaaaauugucuuuauucuuccuguaaacauauaguguuuuuacauuaagcugaauaugagagcuguuucuagugucuuucuuuauauuugacaguuucuacagaggaccauuguauuuacagagucagucaucaaaguuccuccuaaaacauuaaccggugauucuaucgucugccuuuaagaguuaaggaagugggggcuggagagauggcuaagaugguuaagagcaccgauuguucaauuuccagcaccuacauggcagcucacaacuguuuguaauuccuguuccagggauccaacacccucauacaaacauguaugcaggcaaaacaccaauguacauaagauaaaauaaauaauuuuuuaaaaauucaccuaguuguuugguuucuuggguucuuuuuugguuuuugguuuuuuuuaaguagcaaaguaguuuagggggaggaggguucuucucugaguguucaagggcuuccuugugggugggaccauauuugugucccaugacgggugccaugcagcccauggauucuuagucugaacuguaauaaauuugugguucccgcuguguguuugcucucgacauugcccuguccgugggccucccaccccccacacagucugucuggcuagcuagcacucacuccuugcugaccgauguccuuugguuauugagcaacuauugacuccagcagugugacacauuguaacacucucuggucauuuaugaaagcaugaaggcgaagccuacacuacuguaaagcugcaauagcugcaugcagcaagcgaucugcccucgugugcuggccucugcugacccucagcaggccuguccccaaaucuuagucuagugccuuccuaacagauuccuuuucccucugcuuuggcuuuuggugaauuggaauagccugccuauaggauugagugggcagcaguuuacauguaugagacagggucacagccaagucaucuagagcuucaugcuuaguuccuguccacaccgagcaaagagaugauuuacagagaugcauucuaggagucucaaacuaggaagaggccgugaacugcaguuugcaucuaugcucagaaacaacaguuuacaagccuaguguacacgaagaucucggcuucccucuucucauucuaaagcuaagcuugaagacaagaaauccuaagagguuagagauugagagaggaggagggagagagagccgugggcauggauacccugcaugcagugcuaagguaacaaaugcuauuccuuuuaugauacucgagccugucaguaacuugaaauuuucaggguggagaaagugacccacaaacaguaacaucaugugacccauuuugcaaagagggacugaaauuaaaguucugagaagccauuggcugcgcugcagcaagccccgcuguaauggugaaggucuguuuguggcgugccacaucucggccacucucguguuuccaugggcucugagugacugagagcuagagcacacaagcccagugugagcgcaucccugaggcuccuacguaugcuccagccagaagugauagagcucagaguuggcuggagccuucuaugccauccuggguuuugugcugcuuaaaaacagaccgccuccacgcagcugauggccauucugaacaagaaagccuacacuuagggcagggaggcuaguuugguagggaagugcuuggcuagcgugugcaaggccccaagugccauccucagcaccuuaaaaagaaaaggaagcccagaaucaaaaacgaucaacaccagccaugucuccaacaacugucaugacaaaagacucugccuuuccucgccaagacuagugccgauucugagaugggaaggcugcgguuguugauaggacaaugugaagacagacguuuccaaaugaagguagccuuucuacaaaucaugacaaucguugagaaccugagacuaacuccagacgugaaacucugaguugguccacguacacagauagaccuugaaaccggccugucucuggacauguguaaauucauucuuuucuaauuggucacccugggaugucuuucuggucaguguuccuugucuuuaaccccugugacugcaacccaggcauauaguaaucugcucugggagagccauccugguauaagaagucagcccaaaggaagagggaauaaauagagcuguucuuccaugggcgcccuuucuugucacccuuacuuggcugcucuuaccaacaacaggcccaggacccuggcagaggggccuggcucugauuccacauguaaggcuucacauaccccugcuuugcuuggaccuuuggcauccgcuucccgugaucauguaaguggcaacugugcucugugggcacagugucucuggaacgucccuguguaugugcgagaggcuaguguguucuggcugcauucccugugcaccugagagaggucagccuguguuccgauuuucacuucuaaugguuaaaccaccucagggcugcugguccuucaucgcuccaguaguuagagugcagaggaucucugaguauaacacuacggccugucacgauucuguagccggcgaacaguuuuggucaaaguuggauguacuccuaauacacucaguaaagucuggcaacacagcagagcccaagcugucagacuaaaguacauuaacacagauuuguguguguguaauaucaaauagguucgcagguuuuucauuacucccucagccuuuugaauaaugggauuugacagaaaaauaaguccauuugugagacuggacccgcaggcugauuguauaucaaccuaucucucuggcuagcuucuuuaauuauuugacuggaauagaaaaacaaaaggugucuugcauuuugcuagaggaaggaaaacagauguagcauacaggaacugccaccagccuaggggucugaugugggucccuuggcaauggcagaugcuagcugaagauguuagguagagcugaguguccccauucccuuccacuagugugcuucugugcaucucaagaauccaauuuuccuggaaaauuaaaaauaauuugaauacauucugggucguccucuuccucugugagcaaaauacuccaagugccccaacaaguaagagagaaaggaaagaaaggacauuucuuuugccuuuguuuugugacagggucucuucuaucuaagcuggccuagaacuucugaccuaccugucucagccuaccaagucuuagauugcugguaagcccuaccaugcccaguuaguucuuuccuuuuuacuaccucagucccccucccccuuucccuuuucccuuccccuucuucuuuggaccccaaggcagccucugccuucccacccaccaccccagccuucagaaugagggaaacuaaauacaaauuugaucccucuguggcucacauuauucccugauguuggcugaauaugaaucgccauucuuucaccugguaauaaucaggauugacagucugcaaucuuuccgaccucuguguuagucuggcuuuuguuauuacugacagaguaccagaacuuggguacuuuggaaagaaaaaaaagugcaauuggguucaguggagugggucggcaggagagccuugucuagcauguguaaggcccuggguucaauuagcucccagauggggaacuccaagccuaaagagcaugauugacaguuucccuggcaacaucagagcacaggcuaucacggcaagagcucaugugauggggaaagguuaaauaguaaggaggaaccagaaagaccaggaggggacagucuugcucuuucauaacaacacucuuggaaggucuaaccagggucccaggagaacuacuuuacucccuuccuagugcagugacccucccuucccccagugaccuauggcuagacucccaaaugaugggucccacaauuucccaaaaacugugacacaggggacaaagcuuccaccacacaaccccuugggagauaugugcaaagcuaacccauaccagagcagucuccagcuuugugugcgugugaccucccugcuacgccuuguuugcagauuuuagaguagcaauagcagcacauugagaaacuaacuccuucugaucaagagaauggaaucucugggccgggucaaucaccuggccaaaguacugccccuaggagagcaggcucaccugagccguucuaaagagacaggagaaguaauuagcccuuuaaggagaugcuguuucucuaucccgaauccccauccccaaucacucucuuacagccaugccacgcugcuucggaaaccugccagcuuuucugaauuacucagaagacaguaccuuucucuuuccucucuucacacuaaucauguuuuccccaagcucgggaucccuucucuuuauagcuccacagugcugcugcuugucucccauguaccugaccuccauccuggcuucaaugguggagcuuuuucccuuugcuccuccacucuccccuuccagggaaaucacugcugagaugucuagcuugccuguacuggaaugauuuucuuuuaagcucugucuuuaagcuuccauucgaguccauucuucauuucuuccguuaauaagacuaagagccccaagaaggggcccggaucuauucugaguuacaaggcugcucaaaaccucccaacaaucagucccuugacccacccccacccccacccccacccccacccccacucccaccccagugcucuuaagguccuccucugugcuccugcagcaaggaugaauucgaauuuaaaaaaaaaaaaaaaagugccgguuaauuuauuuuuaaauccaccacuggaagugaacauucacguuccuuuucgauacuagacuucugcaaccauuuccauauacacacuacaaauaacccagacauuugugcuugaaaacuugaguucaaaauuauuaaauccagggaugcuguguggggaaggcuuuugaccuaauguucucuagucucuguccuggggaaauucugaggcaucauuugaggucuccagauagaaacccggcagggccugggcccgcccccucuguagcacagcuuuguugguuuugguuuucaagucuccaagcuuuugcugccuaagcaucuguguucucagcagugcugcugggcgaugcugagauuaaaggggauggggcaggaggcucaugcuucagagaaaccuuugccuuccauguauuggggcguggagggaggucccauccacaaaggcauaucaccauggauuauauacaggucauguucuggugccuccagagcugggaagcaaaugucuuucugcuuacucuguuuguagacaccauuuacauuguggcuuaggaacacacacaucagggccaauugcccaccucugcuccaaagcuuugccuccuuugcauaaccaguguaaaucagcucaaugcgggagauagacagcaguuggccauccauggccaugggaccccagcucauguagggccuuccaagagcacacuaauacuaauuguucucucucugucaguuuuacuuuuggucgguuaaucugaaugucuuucuguuaucugaugcaaggucuagacaaacuagucgcuuugcucccuuuauaaguacaaagagacagaaugucaucauucgucuugguaacacccccccccccacuccaaccccuguacaucaagaugccugccacagguggaauugcaggcccugguugacagccuuguccgcagcuccugagaugauacagcuuagcugagucuguguguuccuguguaguacacacugucaggucagcccugcuugucguuuagucucugugacugcuccuuuaccagguuguugggguaccuuuacauaggccacaccccuuugcugcugugucugucccaucaucgauuccaaaucuagaaaggaagugugcagcugcccuuaaagccccccaccaucuccuccugauaccguggcucuccccucagcggcugccgcucugaauguaggcagguuucaugaagcuuuauagagugggguggguacuuuauuuagcacgagauaucauucuauuaaaagugucuucuagagagagcuugggauauauauuucuccaguacuuguuagagcacaggcccauuggaccuuacauagaucauacaucaugggauaacaugugguagagcuccccagaccaguccaccauuugcuaagcauagcagggugauauucuuagcuccccucccccccuuuuuuuuuccucaguggauucucacauucuuagcuuggguuuccccgggaucagagucugagaccaaggcaggcauacaggaaguuuauuuaggaaguagucccagagaguagccaaggauggucaaggaaggcagcaaggaggggcagccaguucaaacacgaggacucuguuggcuaccacacugguagcucaugagaucugcagaagaccuggggagcccugagaacuguccuuuagugagcacugguggcuuuguaggcacccaugccuugggcuguaaucaccgagaggagucagccaggggucuggaagaggauccacaacaaggccagucucuggaguuggccccaagcauugaaagugguccccagaaguaugcccuaagauggcagggugguacuauuggggcucuucaauaaggggaaacugaggcccggaaaccuuaaguaucucuuccagugucccccaggccagaauauguaagcugacagagcaaucugggugggguuuugagcugugucaaauguggccuuugauuauagccccaggccagcaauuugugugguggcugugugggagagcaacugcaaaucugaaaaugaccaucgaagagggugagaaugcagaccggaaaugccagcugaagucccuacaaggagacagcagacaugaccuugccaaagcuggagcagccaaagaacagaggagacauuccuucuaaccucagcuuccacaggcguccuccaugacucugucacuauggacauuaacuaguucauccuacuucuuauuaaaggcgagaugagccugggcaugcaguucggcuuaggaagucuuacagugcucccugcugugugcugccacuauggacagaugccagccaagcccucugcuccuuaauuuccucuuucuaggagcaauucaaagaugcaaaggauuccaauggaaagacauuugagcugauguuggaagcugcuaaaaauuggacaggguuagcuuacaugaaguaggugcacugguggcuuuguagauacccauggcuugggcuguaaucaccgagaggagucagccaggggucuggaagaggauccgcaacaagaccagucucuggggucggccccaagcaaugaaggugguucucagaaauaugcccuaagauggcagggugguacuauuggggcucuucaauaagggaaaaauaaguagugcaccugauaucccuuuaacuaugagggugugugccugccauccuuugccuuuggugaugugcccuucauguccuuucccuauggugaugugcccuuuauguccuuucccuauggugaugugccccucauguccuaucccuauggugaugugcccuucauguccuuuucccuauggugaugugccccucaugucuuuucccuauggugaugugcccuucauguccuuugccuauggugaugugcccuucauguccuuugccuauggugaugugcccuuuauguccuuuucccuauggugaugugcccuucauguccuuugccuauggugaugugccccucauguccuuugccuauggugaugugccccucauguccuuugccuauggugaugugccccucauguccuuugccuauggugaugugccccugaugucuuuuacccuuaacacuguagcuuugccccauccugaacuggaugccuuggaaggcauuuccucaguguggauggugccuuucuccuggauaguuuucauucucgugugugagcgagcauccuucucuaugcuuugcccuuaguuagaaggcguggaucccccugucagggacauauguguauguguccccucugcauuaauguguaggugcagaccuggagagacacugcagugugaugccaggaagucuaagaccagauccugcuccucauuuuggccacagcuuuuuucauuuaaugauuucauuacaacaaaacuaugcuuuuuugaccuaguuaggggggaaaucaucuucuucuauuugauuagauuaucucuccuuuaaccucugguuccguucccacucuuccaaguguuuaagacuacaguuuuuuucauauuuauuuucauacuuguaaucccuugugugcacauauuucacaggaccgcacaugugccugugucuugcugaagcuaaaagugaccagucuuuuuauaacucacauuagaaauacaaacuauuucacaaagcccuguuucgugcaucaauuuuuaagguuaaaauaugucuuuaaacuuuuuaacaaacucaucuuaaaucuuacuaguaggauuuuauuuuuuauuuuauuuuauuuuacggaacccaagcugaccuagaacuuuagaacauuugguaaaccuggccuugaacucaugacccuccuuccucaaucuaccucccaaaucugggauugaagggaagagccaaccauaucuggauauguguguauacuuaauuuuuaaagaacuacuucaggagcugagacuauggcucaguugacaagagcgauugccccucauucaggaagcccuggcuugauccucaacauugcuuuaaaaacaggcguaguggggcacacuuguuaucccaggauggagucaggaggacgaggucauacucagcuauguagcaaacuaaggcaagccuggacaacugagauuuaagcagcagucaggggagguguggcuguacccaacacucacucagauaaggagacaaagcugucgaugguguaacuuuuuuuccuaccuguaguuuaccuuccuuucuuggucugagacuugauaggcagcauauuaaguaccuauccguguguuuacucugagccauuuaaauuuugauuguuaaacagggaccacggcucccucugugaggcuguuaaaaagcccugagcauguuuucacucugccuguggcuuguaguccaucaaaacugcccugcaaaccacaugccccgaguucuguggauggcuguuguuugauuccacugagaagaggcucaaccggaaacggcaaauggugauuaugacuucaggcaaaucagugagugucuaauuaugucuccugacccaaaauaagcaagugucuaccacagaauacacacugugccgagcuucucaucacagcauuucugcuuagggcugcuguguugcugcucacuccuguucagggagaguuggucacaugugugcugcgggcugucauucaugcuggaggagagaagcuacucuccaaguaucaacagcagaaaacaguuggccaugaagugaaggcauacugugccaaacugaacauauuucuucuuuugauuuuuuuuuugugcaugcauauguggagggggugggggaaggggggugugaguguguguaugcuuaggccaaaggagacagcuuuguguaugcuuaaauaaucacauacauguacacacacacaggcacacacaaagauuacagacaggauauuucacauguugaccuagguauaaauuaucggaugaauucucauuuuaaagauaauaucaaacugugagcuugacguuaucaugcccuauguauucccugcauuuucugacucaaccagaagaacguuaaaggacaagauguuugaaaaugaaaccuuuaauguauuuagcugugaucgggaguauuugcuuaacaugggugaguuuguaccuuuuaccugggacuaccugcguaacgccuggagcaugaacuuggggauucaaguucacuggccuugaacuguggaugaaacuguucuagcugccugaggacaguuaaaggauucaguuagguaaauuguaauuuagcauuccgaaacaugacucuuuccggaucaagcauaaaaggcaugugcccuuggaagcccaagaaagaauucauacaguucccauuagucuaaaaauaaauaacaaauaaagaaaugucugagucaugcauugcauuugauggaguccaguggcagagagaacuuaagcuguacuguggaugguggcucugcccggugcucgguggagugaggccgcagcgcucugaggaagugauacgagccagcuggguggauuuaauucugucuuggguuccuccagugcacuaagugugucaugcuuugaguagcaauguggaagccuggcugugccaggaccgaguggcuagggagggacuugccacugucuuugaagcucuccugcaggcaucuccacggagaggcaaguugcagcucagcuccauaggagcuccugggccagcuuguuuaaguuuuccauuccucguugggaaaaguaacauagagauacugaggagcuugucauauaaauggcaaguuguagugcucauuuauagugcuuaccuagugugcaugaagcucuggggucagucccuagcaccauauaagcuaguuuuggucaccaacaccuguacuccugggacuuaggagguggaggcagagggaucaaagguuuguggacauccuccacuauauaaugaguucaaggauagccugggcuacaugaggccuugcucugaauggaagaggaggaggaggaagaggaggaggaggagucaaguugaacaaauuagcacagacuccaaaguccacacuaaggcauccugagugccugcagugagcagacaauaccauggaggggaguuuuaaaaugcucaaggaaaacucacagcauucaacucugucuacuguuagaggagccagaggcucagagccccccaguuguaaugucugaucguccuucugugaagcugaguuucugguggccgcucuugcagaaagcaagccuggcaggauagaagaugaacuagaacucacuggggcaguguccacuuugacuccaaaggaacauugugcugccuauaggcuaaauccacuccauucauacuuaagaaacaacuccauucagaaggcugaggcaaacugaaggucagccuggacuacauaacaauacuuugucaaaaaaaaaaaaaguaaacaaagggucauuuauuucuugcaguuugugugcauuuauguguugaaaugacugcuaaguguuuaaaucauuuggaccuaauguacuagucaauucauuuauuaaguauuuguuucaaccuaggggugcuaugaaagaaguaauaauuacugagacacucuggauaccaggaacuaagaaaaguggaaacacauuggccagagccuugcccucugugggauuucgauuggagacccagcccuccuccuccuucccugccuccagucaagacauugccuuuaguugcuaucugugugcuugucagcaaacuagaaacaugaacagaagugcagagugucuaagaccuuagcggggccuuagaagaggucuuagacuugaguguuuuucuagcuugugaugcuuugaggcccuaucccccuucaggugagcagcuuucccaaguaccugauggcauguucucagagcagcguguggugccgugggacuccgccugccccuggccagugcauuuugugguaggcagaagugcagaagugggcauuggcuuucaaagggcgaucuugccaacuacugcuugcucaugauuuacagugcgcccauccaguccucacuuguucuuaggugaacaauucuaggacacucaguuauauaggaaagccacauugacuugagcgccacagccgucucugagggaaagccucggcgugccucuccagaagcuuguggugaaaguacaagggaccugagucauuuucccauaauuagaugcaguucggaggucugccccucuccccagcccucuugccuugcaugcagggcuguucaguuggaagcuaguggaaaauuccugugcccuuucacccugcugccacaaguuauaaaaagcgugccauucagaacugauuuuucuccugcgugcuuggauuuuuacucacaaaauaaagggggacagugaguuuuaagaauuauauucuacuuaccagugaggcuaggggcugugguaccacuugggaucacagagcagcuggcccagucugcuacuucuuugggggcucauuaaugauaucacugaggccaucuaaguggaccucuuuuuucagagccacaaugacauuagccccacaguucacucagaguuugcccugcuuggcguacuuugugggaaugaggggcaaacacagaagacugcaguaguagaguuugguuuuuguuuuuuucguauuguuagaucuguuugucuuaaucaaaauaugacucauccugccccauuuucaagccaaagcucacugcgguuauccugugacuuggccuaaauccccaugaucugcuuuaauuugaucucgacaguuuccuucggcuguaggaauucagugucaaguuuacaaagugugggugccagcuuuaauguugcaucucugucacuuacugaguccccugguagaaggaccugcccugggguuuuacugcuuguugggauccacauucugaguguuucguuccucugaaucuuggcccccaccuggggugacguucaaggccaaaguuagagcugaaguggagaauuugcucccagugcuuugcuucuguuccaguauuuuccagcugcgaggugcagaccaaccaagaucuuuccccauuccucaauccuucagcccccagccucuuugaugacucacauugccuuagagggcaaagucccuacuaaggcaacagcugccuuggaaauacaauggaaaagcagaagugaggacccgaauccucccuacccuuuauccccagcagccaggagccccacgugggccaguuucagccaaggaacucuguucuccugguaccuucccugcaugucgaguaguccugguaacugcccuggcagcaggggacagccggcucucagagagaaguucugagccgugugagcuguguguagugagcacaccucaccuguuggagggcagugcuauccaggaagaccuacgaaaggaagaaagcucucagaguucacaggagcaagcucuaguuugggaaacuuguauaugccagucuuucccuacgccuugaugaugggaaagguugaaaacagcggcaagguagcaacaucaggccugagugagaagcuaguggacagucgagcccguccuuccucccccaucucacuuucccaucacucgggccuucuguugucuccguucuaacccugaccauaaccuuggggagauucauuacguguuuguccaggacuucaacccacugaggugaucccucucuucagagcucccccuugacgccuccagauugaacagcacgaccaccacucagcaugggcccugaguggccaauuucauuaggaaauaaguugaucuuggacuucacaccagucugcuuuuaagucauucuaacaauagacuccaaagauaacaguguaagguauagcacauggguuuggccaacagagaaguauugaaguauugacuuccauaaaagagcauacguccaccugaacuuacacaugggugugaaaaccuggcuguauaacaaaucacuccccagugauggcggaagcacauuucaaugcaugcaacagcgugaaugagccauugaaaaauagaaucaccgagcagaaguacaggcugcacugcuccaguuauaggaaaucuaaaaccuaucauggguagcaaaauaaagauuagccuugagcggaaaagaaccagccagugagaggaacccaaccccaucagcuaugcugggcccccucuguaugccgggcuagggugucguuacagacaugugagaguacauucaucaaagugugcacuugggaugaguggacugcaggcuguguaauuuacuccuugaaaaacugaauuaaguuucacaauacagcauagcccagagccuaaagcagcugacccagcagucugaaugaggaaaacuagagaccucaucuaguuggugaauggggaaauaugggugcgggggcaggaggaccugaugugcucuuccacagcuguucagcacugcucugagagaauggccuuuccaccuugauaacuaacguauucagaaguccuccucuagcccggcaaaccucaccuguccucuugucuccaggaucucguuacaugugggucuuccggccuggggaacagcuugcgucugggaagccucgggcugcuacgugggaguuagaucccgugguucucagaguuccacaugccucagucugggccaugugaaaagcagagcuugagggaggaggaacagccccuggcugcagggcuccucgugcuccccaugggaggaggaggcaagcccugccucgaagcucuugucucccccucagcaggcccuucauaccucugcgcuuggagccagucuaccgaccugggucccagccucuccucccuugagucuugcuuauucaucauggcaggugcacucuacacauggcagcugugugcagugacacaggcgcagguuuaggggacaaagugaagucuacuguguguccugaggacacaggaagaagcauagaucagcuacuggaggccacugaaaaucugcccggucguaggaagcucugggaugaaaaaaggaagugucaccuggccacuugggcugccccugccggggccuccccagcugugccucuucuccgaacgggaaggagaccuaacuuguaguuagaaccugacaaauggagaagcagguacagauuugccauuguugccuccaaagggagccauguucaguaugcucugaagucgcuuacacauuguagagugcacggcuauuaucgaagguacuaguucugauuaguuuuuguuuuuaucuaauuuuuuguccuaaauauaaccauguuuuuaaaauauuuuuaauuaggcauuuuccucauuuacauuuccaaugcuaucccaaaagucccccauacccuccccccccacuccccuacccacccacucccacuuuuuggcccuggcguuccccuguacuggggcauauaaaguuugcauguccaaugggccucucuuuccacugauggccgacuaggccaucuuuugauacauaugcagcuagagucaagagcuccgggguacugguuaguucauauuguuguuccaccuauaggguugcagaucccuuuagcuccuuggauacuuucucuagcuccuccauuggggcccugugauccauccaauagcugacugugagcauccacuucuguguuauauaaccauguuuuaaagaacacuucauuucacuguacaauguaguuaagaugauauuugucacaaggcccuguuaacccuuuaauaaggucaaauacguguuuuuuuuuuuuuaagaaaaauugaaaccauuccuuuguaguuaaaaauaauaaggaauuucacacacauaccacaaauguuaaacagacaauuagcuugugguuggaaucugaugguuuuauguuauucagcaaaauguaauguauucucuuuagcagcaguuuugcaccaagcuuuccuguuaaggagcccaguuuauucagggaauuuuaaagcuacaucuguaucuaaugacgccucaagauuccagagacuagauagucuaauaaaacccaagacugcaguuaucuucagacuaauauuuaucaguaucuaguagauuccccagagauugauaucaucuguugauacuagaaauuuaauagcauuaaaaaaaaauacuuucagagacccagagagaaaucagaggaaacauuacugaguaaggccgcaucuuguccagccaggcaugcagguugacuggcuagcugcccaagaccccugccuagaagguacuauggggcuggccuuuaacacugauguaguucugacuuuguugaacaacaaagcauccuaagacacucccuccuuauuguagacaaacuaccaacaucugaagugauuuuuuuuaaaaaguguuuaaaaggaaguagccauuuuaaugggcuagccgugcaaccuguaagcacuacaggaggugaacagaucagguggggggaaaaugucacauagaggacaauugucggacacaugcagcuccagagaagcccuucaccaggugaugugcagaauaaagccauugcguuuaugugcucgcugucaucaauguccuccuguucagugcugagagguaaugagguccuggaagagcugggauaugcucugccaccccuaccucaaacagcacagacgcuggguggaaccaaaaccucucagucaugugaucuccaauacggaccuugaucaguguggcucugcucugauaaaaguaucacaacugccguuugcugucuguacuugccugaggguuccuagcacacuccugcucccgcuugcucaguugcuggcaacacacgacuguucugugagcucaccacuguuaccacaaggaagccuguucuauucccaaagguacagagucagguuuuagccagugagcucagcugagagaagcaagaagugacuaggcugguacugaguggccgauccugcucuuaaacaaccauuggguaagcagagggagcuacucugaaggacaguguuuguaacuagguacauggcauucugaggcacacaccuagagggcaggaagggauuggugguugugggagacuggcaggguggcuggggcacuggagauuuguagagcacuggagacacuuuguaugauaugcuagaauggcaccaaaaugucacuacacaguugucuaaugccauggaauggacucaagccugcaccauggcuggugucugauaaauacgacagugcugauagacugcuuuuaacccuuccucuccaauggggaauauugauaaugaggaagucuguguaggcagcagcuggggcaucucuccauccucuaaacugugaaacuggaacugacacaccacacagagagacacagacagacagacagacacauacagauacagacacacauacauacauacacacacacacacacacgaacaaaagaccauugaaaaaguuuuugauuuuuuuuuuuuugcaacuucagguuauaccaguaaaguugaccugcuccugccaacguuuucuuuucuuucuuuuguuuauuaugcaauuuucuuuuuuaaaauuuauuuauuuauuuuuauuagauauuuucuuuauauacauuucaaaugcuaucccaaaguucccuauacccucccucugcccugcuccccuacccauccacacccgcuucuuggcccuggcauuccccuguacuggggcauauaaaguuugcaauaccaaggggccucucuucccugugauggccgacuaggccaucuucugcuacauaugcagcuagagauacgagcucugggggcacugguuaguucauauuguuguuccaccuauaggguugcagacccauucagcuccuugggugcuuucucuagcuucuacauugggggcccuguguucuaucuuauagaugacugugagcauccacuucuguauuugccaggcacuggcauagccucauacgagacagcuauaacagggucccuucagcaaaaucuuucugccagaauuuucuaaugguuuguuuugugguuaaguaaacgugcaaacacugacaagccagggaaguaaccucaaagcaaacuguauaauaguaauagcacggacacaacucaaaagcuucacgcacacacauccagaccaccucucugguauagaauguuucuauucgugcucuggacagacaucaaaguguuguuucccccacccacccccuuaccucccauugcuugggcuuggcaaaauuccugaggcuggcucuggccagaaacaaauuaucugaaacaaucuuaauguuuucaccuauuuuccuucuggcugguggucuugacagcccagaggcccccucagccagagugggugggcagcuucccagcuccccagacacauacacaucuuggaacagaacuuuggacuuuaugcuaauggccuuucaacauccaauacaaccuggcauguuaugcugagaagggcggcuuccuugcuguaaauccaugagcagacaauuucaugacauuuuccccccauuuuccuguugaguguuauucccaaaauacuuuguggucugccaaguagccaucuuccguuuggcuacuugauaguucaaugggaugcuguuaauugaugguauaaagaagugagcccaggguuggaaguguggcucagugguagaggacuuaccuagcauugcuaaggcucugggucucauucccaauaccaagccaaccaagcaacaagaaauguagccagacccgugagucuagaucuaggcuuagccuuugucuuaugaauuugcaagaccagacauagcaaaggugcagauguguguccuaggaggcacaaaacuccucuuugaaccaguuggugaccagaacaagcuaccccguaaaaguaagcugcucccaucaaacaagaaagagcguuaggggguucagaagaggcgucuacaugugcccaguuguucuugguggaauguaacaacauagauggagagccugggcauuugcuuccucauagaaacugcuucuucugugagacuucauuagcaugauaaaauaauaucuccaagguauaugccuuaguaucucaucccuuaagaauucuauauugucuuucuuuuuuaaagaauucuccauuuuccauaaaaauagauauuucucuaagacuguauguauacuuaauaaugaauuuuuuaaacuuuaguuucugguugcauuuuuuuuaaaaacagugaauguugguuuaguacuuucuaguauuaacaaauugauuccaaagcuuauucucgaguguggaagguuguucaaagggagguuagaggcagagacacgacccucugaagacccugguggggacaggauguuggggacacccucuaauugguucuccuuggauugcagagauaauaguucuuauuguuggaggaguggcgcuggagggaaggauuggacccauuuuccagguucauguggcuuuuugccauuugguacaggcuagaaauaggaugugaaagcuaaguaacuuaauggggaacuaucugcaucaaauauucacuuaaagacaucaagcugggaugccagaccuaggguuuggguggaggagggcaaguccugucccuuguuuucagcccacacgugagacacauuuuaaucccaucaaacugguaaaacuucuacaagauugcccaaguuuuaacuguuuuuauuuucgccagauggccugguuuuauacuuuucucaucuuaaacaugcaugcaguacuggugccuagcugucuuugguccugcccaugcuaaggaugcuggaugagaagucuguccaagugacuuaacaagucagcaugggaggggaagggcacaggaugcuuccucagacuguguaucgucaagucauucgugguggugcacuguggaagcuggggauccauccugcaugugcuuccagaaagggccugggucugugugaaguugccaagaguuugcacgcauccuuucucuugguuauuagacacaguccuuguuuuuacuguccagacuauaaaguagaacucccugccacugcuuaaugcaaaaaguauuaauuacccagcgccuucucccccuuuuaguggcccugccgccauccucacguggagaggaggggagcuccccacuccgcugguccugcugagggagacuugcuucuguuccgggcucugggugucggccagggugcugggcuuuucagguuccuuccuucucaaggcuaacuaagcuaaauuauuguugagucuggcuacacauaaacauuauccuucauuccgcaugcuuuaaaauacuugucuguagacauuuauuuauacauugaaguguuuaaugggccauuugaagauuugucucauauagcccgggccugccucugaacuguguauuggcuauuucagaaacagguccacuuagaaauagucaugcuuuucauuuuguggaguuucuuugcagugaccaaaggcuuuacguacugccaacacucccuagcccaggccugaggguccccucuccaaggguguguucuggguggugccaagcugacuucacaagucccuccuggccacauucucaaguagucuccucccccauccacuuaccccagcauccagaauaaacacuuucuggacacuuggagccccuccgucaauauuuucugagcaaauaaaugaacaugaaugacuccaacgcugaaggagaaacaccuccagauugaugaagggucucaugguauucacucgcucaggucugcaaacuuagaaaaaaaacauggcacuucuguccaaauccauauucauaugccccucucagcagggccuggcaucuucccagcugagacagguuccccugcgaucaggggagggcuacacacucuuccucucucugagcuccucgugcccucugaaccacacacagcacggcguuaucacaccgacguagaagcuaguuuacaaauaugugugggagaucaucugcacagugccuggcuagagauagccaagagcuuuaaagagaacuugugccaagcauguugucccacccccugugcuagcauuaccuguaccuacugcuucagagguaaaagccugcggggaagcugaguggauuucacagaagacucuagaauguacaagguucuucaggucagaagacacaguguagcaaagguggcagugucuagcucuggccuguucaaguagagugagcuuuucugcuaacaaagccuauuuuugaagaauguguucuacagagcugauacagucaggcacuuacacacacacacacacagugucacaaaggcagaagguacuuugucauuaucauaaauuaauagaaaaaaaucuucagauuuugauccaugauuuagaaguagucugcucacggucuauuguccccagugucuugaucccagcucaggaaguccccaugcuguccuguucuguccucuuuucauggacaguuauggaaagcuacaaaguaucuccaucaguuccuauggaacugucagccccugugcucgccccccuccucuuuccuuuccuguccugccuaccccacccuaccccaacauucccuagucuuuaguccaggugcucccuucguccucuccugccuucauucugucacagguguucuuccuucccgcuccuccucgugugcaaaugcacugggcuuugacccagauguucccugaccuggcuccucaguuuuguuccuuucccccauuuuuuuucuucccgccucuuuucuuguccccuaguaaaccaagagauauccuggccaugcuauaaugccagucucugugauaagaaggaaagccacauaucuuuacagugaccacuguaaacaccucaaaguacugucguggggggugggggggaggaggaggaggaagaagagaagggcuuuccuccccuucuuccaugugcacaguuugacuuuugauuuuuaguuuuucuuuuuuaagaaaaaaacaaaaaacuaguuucuauuguuguuguuguuguugcugcugcuguugcuguuguuuucaaacaagucucacaauguaguccuggccgucauggaauucagaccagacuagcauugaacucauaggcaucugccugccucugccuccuugaaagcuagcauuaaaagccuauacuuuggaguuuaacuuugccuauaucuuuccuaauauuuguauuuuuuaauuguauauucggugauaggauugguuuuaacuauuguucuuuaaaauagaaauaaagaaaaaguuuaggauaguuacuguauguauacacuuauguauguauguagugauuguauacacauguggaagccagaggcaaaugcuggcaucuuucuuagucucucuccacuuauuuaugaaucaaagucucucgaugagccuggaucucaccaauucagcugaaagagcuugccagugaacuccagagaccucucucugugucuacacuucccgccaaauacuggagucccagaugccugaugccaugcccaguguucacacgggucccaggauuuuucauguuuguguggcagauaggucacuaacugggccauuuguccagccccaguuuuucaguuauuuuguguguuagaauagaagcagcgugggccucagugcccuagccagcuuucagcuaaagggacuagcagguagauaaacuuccagauugcaaccuguuuguuaacucuguagaccccuucuaacuaaaguccacagaccuucccgugucagcauugagaccaaaugcuuggucuucuuucucaagaagggagucauuucuuagccucaagcccugcaggcuugcuccauggggagauguauaaguaguuaaucuaacauauccugcaagccuguuuaauaggcagggaccuccugacuacagcauacaaauuacacuuccauguauagaaaacaggcauccuuaugcaccaugaagaguuggcaugcacugugcuuggcaugcucgcacuuuggcugcucuagugaaaagcuacacacgguaccauaccuaacucuucaaacacacuauccucccuacccuagggccccuagucccccucaugccucaaaaugaugaugcuaauauuuaauggccauaaucauauuuaaucauagcaguugccuccccaagaucuuggguguuuaaucaucuuaucuaaaugcaaauaaaauaaaaaugcuucuaauacuaaucacauacauauuccucaacacagcauuuaacuucuggggguucagcuucuguccuccaagcugcaaggcaacacaaugaccauggugucacaggggaugagaacgcaucuuuccauaaugaagcaggcucuguauucuuuacuauacagauaaagagugcuuugcaugcacgugugcacgugcauaugcacaggugggaagggccugcagagccaagcuccucugcaaagcccucgucuugucacauguguucccaguggcagcaacgacauguucaggaggaguaugagggcucuguuccucuucccuccgcugauaaacugcaguuuccagaccucucuccaaggauaucuuauuaucgcuuuuaaagaacgcaaggauggcucuuccuggauuguacuuguguuguuuaaacaccagcaccgagggggccaguggcagaggaaauguuuacaucaagcuaccacgcauuagcuguguuuuucaagucguuccgucuuaaaguggccgcgggguucauagcuguuuauaaaauauacggcauucaguggcgugaaauaguuguuuauuuccuuuccauguuuccucuuguugcggaaaaaaaaaguauguuugaccuaccaaaauacaauugugucguuaagcugggagccuguguaaaauguguuugcaaugacugggacagaggucuguccuaacauuuuguugaucaccugguaggcugggaucuggccaccaggaauuuaucuuauccuuccuuaaccacuccauggagagugggucuucccccguauuguucauucaugugcuacacacacacacacacacacacacacacaaacucucauucagaaggcugauacuuccuuugcaugacagauuaaaggggcagugugggcucuuuugaugauguguccuagggguucucuuagguuaaacucccggggcucuucucagcacucagaaacugaaauacuauucaucugccaaacucaccaaaacccuuauucccucccacacacacaccuccaaggguuuuguuuuuucaaacucccaaaagcuggaugguucuuuggugaauuuugugcagagaugggggcagggguggcaaggaaauaaggaaacguguuuaaaaacagcugaaagaaaacacguuugacaaugaaaucaaccccugccuuuuucuuucugugauaaucuauaaauagauggugcucgcugcugcugcucuguuagcuacccggcuuaucugccguuccacuaguccuuauuuucuucccgaagagaaaagcaguguuuauuauugcaggugccaaaacacagaggacgaaaacaagcagagggauuucaugcaaucauuccgagugggcuucauauuugccuuuugcuuuuguuuccgugccuggagcccauaaacccggugaaugagcuggcaaauugccuugcucaggugcggcucucgcucucccggagcuggagcaggugcugaugggagcaggugcggagcugaugaccagauaagcccugagccgcccugccccucugcucugcuccggcagaguuagcuaaaaagccgaaagaagggcuuuugagauaccacccagcuacuguucaaauauugaccaagagacccugggaaggaggagauuguggccaccuuacuuccaguuccuccuccugucucuaagcugcuuugcaaagccccgcaggagaugugguuucccugcgcaggaaagccaagcccagguauugccuagccuggacucugcugagcuugagccuaagaaaugagcagcguugcccuuggcaaaacauuuuccccccugguuuggugacuguuuaucuuagcagaggacuuggcaguuggcagauuaaaguguuuacuagaaggcugugccucucccucugcagagcucugcaccccccaacgccacaguagauguggaaggucccugaaugugugcaagacaguucccaaagaaguccaaagagacacgcagauaccugggaccccuccccacuccaggcccugggacaugucucuuaacauuaaaguuuaguguucagcuaucugugaguuuugcaaaggagaaaaacugaggaaaucacccaggaaaaaaauagaagaaaaaaaaaauuuuugugugccuguaguccugagcaaucuuuguucuuugauuugaaaaauucccccucucuccacaagauuaaggccagugacacucauucauuuagacuccggguuccagcaaaagcuuguccacuuaagaaaguagggguauucgugagaaacauagauuugggccccgguucuguucucagauuaaggcagggcaucaaaccaagagauucuggugacaucugagaaaagcaaauuaugucuuucugggaagacguacuaaaugaaguccacaggauuuuaaaagauuuauaugacuuuaaacuauuuccuugugagcaugugaugucauugucacaauguguaacgauucaucuacuaucuacauucuuuguuuaaacuuccuguggaauacauaugguucacauaaagaauacuccggggucauuugagguuuuguagaaaacaaucauuugugaaagcaaaacagacccuuucagugucuuauuuugguuacggucuauaaaaaggccaugaaacagagcagucgucgcagccccaagaacaaacugucagacccucucagcccgcccggcguggcacgagcauagcagucccacguggggacaagcucagagccugucucuggaacugaacgggggucugccugcagugucuccgggacacuugggaaacacggugccauuuccagauggcagccccuucacagcgcagcccugagacucugagaacacaagguuggcuuuauuuaauuuccucucuuuuaccaagagucauaaucuauuuucguaaagaaauucaggaaauugguaaagcacuugacuccauccguuaaguauccguaauuaacgugauugucacguuuuuccuggcuccgugcugucuuguucacagccucccucacaugccuacaacccgcugagaagauccugguaaugggugucacuuagucucagcuacucaaacaaaacagcacgcgcgaucugcagagaagcgcacuuccucugcuuggcuagcaaagauuccuaaguucaggggguuuucugaccagauucuggcauucuuuucagacaaccccucuguggcucuucucucugugacugcuuugcugcagggcagcacaaaagaggauguuugcagcccaccuccgcagccccagucccugauaaagccagggcuauuaguucuugcucaccagagccagcccaccuuccuaccuucaucagccacuguguguuguucucuagaauguucuccagcaccugcagccuuugcacugagucgucguagucgaggggugcaucccucugcacggcauuggacauguaggggcuggaggaagaucggcagcugucggucuccggcagcaggaacguguagcugcaggguccguucuggaccugguacugccuucugccugugcuguccacgcucuuccuaaaguuacuguaggcugaggccaagacaagaucccagccaaaaguuaggaaaaugaucugccacauucucucucucuuuuuggguucuaaacugugaguucagcaaacuugcguccugagcucucagcugcugucuaaggcacagggcugugccgugugaauaaguccaucagugagagccuucuccgucccgcagcaggcucuuucccagugccugucucuucucuucucuucuccccggcacacucggagcuguccugagaggaaggagcagcccugcucacuccagaggucugcacggacucuuuguuucuccccugagucuacagugucaguauccgaaucaaucacuuuccuucccuuauaugauaaguugauaagagcagccagacaugugcagccagccgcuccgcccccuggcucacccacuaucuuccuguagggggucacuagccaggcaacaggaaaaaucagagcauagugcuuacugccccaaaggacuguguacugcagaagccuucugggaacacagaccagccacaagaccccugggcaugucagaggcaccacccuaauuauuuccuagagaguagcuggggcucuguugucugucugcucguuuguaggcuaagcuugcagaguaucugagguaaucacuuuaauuuuaaagcauagugaaaguuucuguucuuuuaggaauaaaauuacagcuauaucgggaccuugguuuauuuucuuuauuguaaauauaaaggcuaagaucagcccuuguaaaugugcuuuuccaaggggaaguaaagucuuguugguauuugguuuuuuuuuuaaguuaugcacauuuuuuuuuauuuuaacccaguuugauauuauuaaaucaaguuaccaacaucaguuuucucagcacucacaugucugugccuuaacacaaaauacuauacaaauaaaacuuaaaguaguuuggccugauuaauugucuguuaaguaacaauagauauuugagugaaguaugucgagaggaaacaaacauacaccuuuuccuucacuguaucaggguuuccucgggcucaucacucuguggcauguuccugauuaaauuagucccagucagugggcucaggcaaaucacuuuccccuuuuaauuaaguucaaaagccccuggccauaaaagcugggggcugcacugacuucuaaaacacuuccagcucuguggcucugcugguccagagucaccaccccuucaugacuagaaguuaaugcugcagagaucgguacugggaagacuccagcaucccugacucaaaggaccacguccgccuccagaaaccccagggcaacucuguguuacacauccucggcuucuggaggcuaggagagucaugauuuuagaucauaggugaaucuagaaucugcauggggaauguuguuuuucacagagucuguuuggaagagaacuaacugaaucuuuuuuaaaugcauccuguagcagacuggcucccgaguuggcaacagaagaggguuauguuuugguuuuuuaccccaagaucuacaggguccaugaacuuggaaaagaacaugucuauauuuuucaccaggcaauaagugauauuuagcucuuccuguaucucugagaacugaugaaccauauuuugccaucagugaagacacacccuucuuaaagacaccaugagccucccacuccauugaagggacacauaggcucagagacuacuaccaaguucuguggcgcagaaaggccacagcucaugcucuggacaauuagcuggggguggggagcagucugauuccugagagaugaaacagggcucacgagugcuaacccccgcagucagaaccccucagaaagagcaggcaggccucaacuucagucugagugcuacgugcaaagcuuagcugcucucaggguuccuacuuggaaaauagaaaccauuccuucucuguggaauuuucuggauuaaguugcuauguaauaggcgcaauuuaaaaauacuaacucccuuuccuuacagcuugcuuauuaaauggaaaugaauuugguuaccaucacacaguagcuccugggauagucaggacaaggcaguagcaaugggugcaaaucuuuuagguuuguuuguuuguaagagcacauuucaaggcauugauacaugguuuagauuggagccauucaguuguguuccaggcaaaucaagaagaaacaaggaaaaagagauacgccacauacuaagucaaguauucugcuggguauagggugacucacagcaagacuucugauccacagggggccaugggacuuagagggaaagagaccauaggcagagaacuaugagagugcauagaaggugacaccaccuccuggggacagcaggccucauucaguuccacagaacacaguagaagcuguacuucguagauucugacauggaaauuauuaaaaguggggucagcaagucucccuuuaggaaugagguggaggauucuggccuaugggcugcccccucuuguugacugucucagcagucgugacagccgccgugcagcucuuggauugccagaacaacuggguaccaauaauaaggcuuuacucaugaauacggcccuuuaugucuuuuacuuucacacccaugacauaauccuuuuuguguacuuuucaaucauuuaggaauguacagagcaaggcauaguggaacaugccugcaguucuagcacccaggaggcuauagcaaaaagauuguugcagguuucaggcuagucugcacuuccauauagugaguucugugccagccugggcuacauagaggcucuguuucaaacaaagcaaaauacacucacacgcacacugcugguucauucacccaaauagguuagaaguuuagagcaggagggagaggagucggcaguucauacccuggggaugggacauauucagugagaccaggcaguguucgcugcguauccagcaugagaagaaggccuuuacuuaacagggugacauaugccagggcaaggggcuaguacaaagcccaaagaacacugacacuuugaagccgguuauaaggugcucagaacaugccaccauuccagagcaaagaguggcacaguguagcagcccccagggccacaggaacucagaggggcucacacagucagaacuucagcuagagugcugagaggagccucauaggagaccugcacagggaaaagagcagagaccaaaagagcccagguuucccuucugcccuggcugaaagugccacuagccaauggacacugauugccacuacggccugggguggcaacuaaaugugcucggaccccauccgcccuuuuuuuguucuucuccaaaguguuccuuuuccauagaaaaucagccucccccugcuuaccugcugacaguauugcuaaaguagacaaagauacaaacugggggauauauuaucaccgguuucccaaaaguugcccuaagccucccucagcucuggggagcagcuguggguggugcuguuuucuuaagugaguguguuuucugccacguugcaugucauuagcugaaauuucagagcccuguuuauccucuccaggacuguccccacuucucauuaaaccauuugauggcaccagaaagacauuuccagaaaguaagccaucugcaaagaccuuaaaaaacaauaguuuaauuaauucucugggaacuucauauacuguaguuugaacacauucacacacucauaaccauccuguccacccucccccccaacuucucgaugaugauaaugauaacaguuucuuuugcugcuucuuccuccuccucucucucccuccuucagucuacccaguucguguugcccugauaauuuugagaguggggccugcccugguguguggucaagcuaacaggagucaaacauaauuaaaaaaaauaauaguaauugauucucccucucucaccagcugccacaugccaauaacucuucagcucauggugggauuucaugcccacccccucucugggauuucagcuggcuguugccagaacggucucguguaugccagcccuguugugucuggaagacacuauuuccuugauguugcugaccaucuugggcucuucugcauauuauuccacaaaggaacaugagccuuguagagaggaaugugucacaaagaccuuuaagcagcacccuguggugucauuguaccccauucagcugagguaaaggcuacagggccuccuguaggcuuugguuuucccagauccuucaggaaucuaauaucucagauccccugcuguccgaaucuuggggucagaguugucagagacgauaggcaagcuagagucacccagcagaccauuggcccugcaacugguguccuagaaaacuggguauuccacacuuuuaaaucagcacaaagugggcagcucccaugugaccagagggcauuugugaacagcucccacggccuccacagucacugugaaccaguuuacagaaugucaccaagaguuuuguccuugucacaugaguggguagagauauguggccucucuccugaccugggagaaccagcacacaacaagggacauuuuacaaaagccuguguugugaaacaauccacagagcucagauccuggacaggacaggcucccugaacuuggauagggaucacacucauucucugcagagcuaggcagccccucugagccaguccccgucuguccccucaccaggaacagcacaguccucuguccaugucaucacugccuacagcccuggcgugcugacuggcacaggcacugaguuuuggaaagcgccuuggucuaugagggacucucagugcugaauuaccguaugaugugaagcugggacacugugucuuugcagucagauggguacacucggaacucucaggcgucuggcaugcgagagagcagggagagaacugaggggccacuuggccaucucucccacugcccuuggcaucuuuaaaauuaucacaauaguugauacauuucaacauaacuccucggcauucauuuucagggaaaagcacuaggugcucaauggacauaaaacuuguugaaguuuucuacuacucugcaaauugucugcagucauuaggaaaaagcaaggaagcaacuaaaauguguguacgcacgugcaugugugugcgcgcacacauaugcacaaaugcacaugaauggaauuaggaugaugauacuauuucagcaucccaauagcuguccccacacagaaauaccuuggcaucgcucguuucuacucuguguauguugaccugcaucugaacagcacagaagcagacuguggccaucagcacacacaucagucagcacacccacugccaccacucccacacggagcccggacucugcagugcuuguuguggguaauccccagcugcagauuugagagaagcaccaaaggaaagcccuuugcuguuacucugaggacagaagaaaaguucuaagaggcacacagauugguccauauggucuuagguuuuuguaccuguuacagagaagagaccaaggcucacugagguaaaaagcaaagacuccugucagcuaaaugcauccauagacccuacucuuucacugaugguaauggcauugaacuuaaagccaugguauguauacgugugugugugugugugugugcaugcguacaugcaugcauacgugagugcguacauucgugaguccucaugcuugcagagcaaauacugguacucacugagcuguauccucagccccuagagcagugauuuguuuuuucucuccaaguuuaacaacuccuuggaaaagauugagacuuccuguuuagugcuggcugucacccaguauggcacugauaggcauccuaaugacagaguccacagcaugacccaaaacugagcuucugguugcuguguaaaaguagaagcuugugugaagagugcagaccugugugagggagcagccgugugugagcacagaaacccagugaaucagugugucagugcccuggcuagggggauccaugcggcccccacauugucuagcuuuuacaacuccuucccggucucucucuugagcuuuauccuguauucccagcuaaaagauucugauggccuaugaaguaaaauagggugccacuuggagcaugauugcuggucucacuggaaguauauguuuguguguauauuuauguauguuuucuguaugcacauuggccuuugacauaaaauagcuggcccagaauauuuagagcauaauuaagucauuggcuuagaaucaggcagugaguccguggaauucaccuuugugagaggugaggaagugaauauuuuguuaaaaucauucucuaacugccaaaggagggaagggcugccugccagauguguuuucaggccacuuccuuuccugggaaacagccauuuccgcccaccgccggcauguuuucauccacaagucgauggugacaggugcagaaaaggagcacaggauuugcaggacaggccugucaccccacagucaccaucuucaucccagcuguguagcuuguauuugauaaagaacuacagcccuggcaugcugugacugcgcagggcagggugagaggcuauagaaaggucacgugaucuccugauaccugccauucccuuuaaaguuaccagguacucagcacuccaacuuaugaguguuuacuaugaagucaugucugaaugacaguuagauacaguagauuuuuguuguuguuguuuuaaagaaacuuaaaagauucucauuguuuacacuuuguaccagcaggaugcagcagaguauccuguuaaaguacguucauaucugauagccacacugugugucuucucaagcccacagacucuaaaagggggagcuuuuuauuuauuaaaaacuugggaaauaugcaaguaaauauuuuuuuaagauuacaccacaaauuccucaaauuuuuaggaagauuucaguuuauauaauuauucuguuguauaaaguuaucucaaacacuguuugauuuuuaaauauuuucauucuaauauuuuuguggaauauuuuaucucuccaucugaaacaagaaaugucaaaaggguccauauacgagugagucacagguuugggaagacaguuagugccguucuccagagugagugagggccgaccugacauuucugcucuuucucucuggugggaaaacgguaaacauucuauguaaaggacucgugugcuagagguaguuacuucacucgugacuucagguaaaucuuuuccuugacucagcacuugguauuugaaguagguuuguuagcuaagauuuuacauugccccuuccuaaauccauucugacacacuuucaagaguuuguaaccuacugugaaauguguccagccucccuccacagccauucuaaugaacugucugcaucucucacagacgaguuuuccuuuggaaguggccuacugccaucuagauuaaucuucuuugaauauaaauuuauaaauguuuaucuuaauuauugagaaacuuuuuuaaaaggagauaaaaaugucgugaguauucccauuuagauauauuaucucucuugguuauaaguuaacauaaauaaauggcuuaugucaagguuauuuuuuuuuaaaugcacaugacccucauuuuguauucccauccaucuggcuaaguuaauacgaaaacucugucugugggaacuuacauuccauuauggacuuacauggacaaaagucguuuuugaaaaacuugagcacaaccaugauaaauaguugagcauaaaaguuauagccaagcuuaugagcaguuaugaugcuccccguuagguguggaaaagacccuccgcuguccuugucccagcauggauccauuugucucucgauggccagguuucccugguuauuuuccuguguacucugccuuucuuucaaacucugccuuaaggcccucaucuggcacccacuaccacauccaccaaagguuccugcuccaggaaagggcacaagucaaggaaaagcugacacaaaauaaagagaaaauaaaaggaaacaaacuggacagagaccacaaagagggcgcaguugcaacaguauuaagauaccacgcugcucacaucugcuucccucaaggggaacaaaauaugcaauaaugcuuuuaaagccuaaaguacuagucuaauagaauauuuacaggaaaagaaauuguauacuuuccucaaaaaaaucauuaugccuuuaaaugaccuuacauuuuuuuuuuagccuguaugccaaaaagucuuguuugacuacaauaaaaaauuaagcgcacagaacccugaaagcaagagaagguacucucaaacgcucuguuaauacucaccugcucccucugcuggucuccuaagaagugaccgacagaagugucauuaaggucauuaauagaaacgcugagcaguuuaagcaucaacugguaaguaaccuggaugcuguuagucauauugcaaaauggcacagcauagacaaagccuucacauccgugcacgcaggcacaugcguguagugcacacgguacacacagcaguacaguuacugcccagaggacacagaagucugugcugccaauccucuggggcccaacugccugaagcaagaccccacucuagugaaccugagugguacugugacaaaggcauugcuuuguggcaccaauggugaacuucaugcccccagaaacguccccaaagcagguaaaggcuaagugaacugccggaaugucuccaauguugauuuugaucccaacuauuaacuuagucaaaaagaaaccaucuugccaaccccaacuugccccauagagcaaccuaaacugagagaaacuacauuccacacugaggaaguugguugcauaauuuaacaaugaaaaaaggcacaaaacgugaugggcauucagagaacccaacugcagcuuaagaaagggauggugaaggaauaaacucacuccacagccagcucagccaucagagccuacccacccuuggagaacucgaggcaguggaguagcccacuaugauccggagaguccucuggaugagguauggaaaagggguaagagggguagagucagagaggccaaagacaccacugcggucccucagggcagacaugguggccugagcuucugguguuaauuuggggacaugcaagaggaagaagcaucagugugacuggcugcugugaggagugcagagauugggacuggggacuucucugucaccugaaaccauuaucgaugcugguuaggaggcguaagcccucgcuaagugcuugccuaaggcgagcaaagcccugaguugcaucccagcagcacagcgcacggcuguuggggagaauggggaauaagagggaaacaacuuuaggugcuggaauuauuuccauagccugagcaccauaauaagacaauaaaaaaaaccaccaggcuuaucuaguacuguggagggugggagcacaaccaugauaaauuuuucugaaggcauccuguacuggcgauaugaauucucccccaccuuucuccaccuucaccagacagaaacaauaagaacacaagccauccuuugcuaagcagaagccagcagauagaagaaguaagcaggcuagcaaagccuucacaagagggaacucauagaugucuuucuaccccagcucugucaucuugcuagaucaguuccuucggguacuguuaagagguaccacagucucagauuuccgagucauugcuagccuccuuaaacagccuuugcugacauccuuaugugacauggauaaaaagaagcugccccuuacucaaagugccguggcuggcauuucuuaggcauaguacugaaauuaauccaaucaauaguccuucaccgaaggcucaccggggcaggcucuguggcuucuggcgugcuaccccuugccauaguuucuguucugggagaaacaggcaaugaauaaaauaaagaggagccaguccaauuaguaaaaagguauaaagagcccaaggggguugcuuaugacucaaagaagaggugagaccucauaugccggauacauuguauagcuuuauaccuuugcauuaauuugucauuugagguccccuguuaaggguuggauugugcuaacccuaaguccaaguugaaauccuuucuucaagggccucagaaugcuaccuuauuugcagcuguaaccauucagguauauugauuuaaacuggaguaauacugaaauagugagggccucucucuauucaauauggcugauaucuuuuuaaaagauguucaugggaagacacagacauccucuaaagaugcuaugugacccuggagacagagaccaggugauaguacccucagacagccaucagccuccagaaaccgggagaggccagaacagguaccaucauaggucauccuauggggccauccuaucaacagcucggccuuggacacucuggccugcaacgccaugugggcaugaauuucuguuccuuaaggcccucaguuuuguggcaguugugauugaccuguugaacuaauacagcgucaaaaacaauucacauuaggaagaagauuaccaugugcuuccgccaaacuagccaccugauuccucaugcuuccuguuuaaccugggggcagugggcagaggggauccaggcagcucuugguuuguaaugauggcaauacccaugcccaguucuugcaacaccuuccugggaagacuacugaucugcaauugcagccagccucuaaaggucugggccacauagccaugccccuuggaagcucuccuugucuuucuacaugucaacucagggucacugcacuugagguacuggcuggcuggcaauagcucacuaccuccacuaugugguugcauccuaaacugaggacuuagaagacugcugcugcuaagugacugguccauauuuaucugcugccccugcaaggaucuauagagugaaggcaugcagguguagggcuccugcaauucugccaguguuugucacugcugccugugugacaagagccccuuucuauccagccugcaaguucugcuacuugaguggccuucugaagaaagccaaggugaaguucucagucccagccaucucaggcuucugcugcagcagaggaggacagggugcugauugguugucaugagcccuugguugggaaguuuuacucuagacauccaggaucccuuugcucaaacucugcagcagcugguagcucaucuccccuccuggggccucaacccuuuaagcuguggugcuguggagcucuguaauggagucuccaucuugucgucauucuaugcagucuacgauuauugcuuucauuguaauaaaaccaauaagcauacagaggucggcggcucugagccaaacucaaccaucagaugcacggcaccugacauggaauaaauugauccuagguaaacacauucagggauuccaugugugcaaaugaucuucuaguggcuaugcuagaccuuacauuuaaaagucuuauccuucaacauuauuuucacauguauaacucugcccuuauuccacgacuuuuagaacuuuggggccuauguugaaagccaagcaccuuguauuugaaaugccaugauugguggcaaaucuuccccaguuaagggcugagaaguuugaguacuacaaaguuagcuuacugugcggcucagcagccuagacuguuagcccuuuugggcuucagugggcuucccuuguaguaguccugaagagagacuaggcaaggauagaaagagcucuagaaaguagggucacauguuccuucaccuccagacaagaguucuagaaccucccaccugccugcaaaguugcucuaaggaaaguaaaaacauuauuauaugguggguggugggagccaggucuuccccagccuccuguggugcacugcaucuccuuccugcaucucauuuggacguuggcguccccugcucucuuuggggagagcuucagcccuaagggcccauccacaguaggcuuugcugucucugccugcuacaaauagcucacugaccuugucucccaugcauucaguugccucgggaagugugaggaccaugaccuuugagcagaauuaagcuugaggauggcuugugggagaaggaagccguggaaauucuuuccgaagcggguauuucuaggaaaaucucagccagaacauacacucauucacuacccaguaucaaucccacgcaccuguucccuacccaggaucagcuaaucagcauuguuagucggcaaagggaaagcgccaaacaaagccaccuaaaacuuugggaagccccuuugcauaacgugcuuauuuagggcuuagaaauaugccugguuucagaacaccauaagcaaagccccgcuuugcaccugugcuucggaauguauuuuaaaugucugaacgacagggaaauuuuugaauuuuuuuucuaaauauaaccuuaaauuuacuguacaguuguuuucucccucuuuugagaauaagacaguccugcucugugacuaccaaaaugucaguaauucagaggaaacagacuagauucagaugggaggcaugggaggcagaggcagcuggaucucugugaguuccaggccagccuggacuacaugauguuuccaggacuccaaaaggagaccuuguuuccaaaaaaucaaauuuacagcaccaccugauaaacccuguguuuguuuauauuacagcagugauucucgaccguccuaaugcuguaacccuuuaauacaguuccucacauuguggugaccccagccauaagauuauuuucacugcuacuucauagcuguaaauuuucugcuguugugaauugucagguaacuaucuauguauuccaauggucucaggcaaccacugugaaagggucguuugauccccagguugagagcuauuauagcaguaauuaaacucaagcuccuagcagucacccugccugccucagccucccgagcgcccaugcccaacaugguugacacuuucagaucugcugagacacacagaagagugaaggcuucaggguucuuuaguugccucaggacaagcaugggcucauuaagggucugggcagucuugcccagcuugagacggaagagcugaccuauaccauauagugcuccauucuccugcaucugacaaagcacuaaagaagaauucccugcacaacugaaauggguccggucuguucacuuaggaaugaugaccagagugcauucucuccuccgcagagacugaaaaccacaucuguguucagagcuggacugccccgagaucuucuaauuaacuccuauguuccuuaggacaguguuuuccuggaacauuuuuuaugagaggcacuugagcaacuguuuuguuacacagaugagcuaagcaugccugacguacagcuuaggcuauuguccaugcaucuauuguugcaccaaaccugauguuagcaucuuaaagcagggcugaagguaugugcagagugucuugcaucuuauccugagaaaagaucuuaggaaaaacaaauaugcaaagggcagccaacagcaguuccuucaaccccaaagcucgugucuccaggagucgcuggauuuaguaguuauaagggaagauacuuaccgaugcccucuaauauauacauaccaguacaccagcccuggccaaaagcuaaaggcccuauguacuguugucugacuggcacaugcuguacuaaggacacuauauaccguugucugagagguggaugcugccccucccuccuuuggacucucaguccugugugaugagucugucucuguguaaauggcuaugcacucccagucugcuccacacauugggaaacaggcaguugccaaauggaagcuggcccucaaaugccaaccaagggaguaagauccauagguaucacaaacacagucugaccuacaaacugaugccccuauggcugcuagcugccuuaaacuggaaucaucugagagucaggaagagauuuuggagccuucauguugcucaugacccuguaagacaaaaugccuuccccgggagacaggguaucacuggaucaagguuccugacuccuguucuauagguaaucgcacaugguguuaauguuauagacucagagucaauaacuacauuacuauuuuaauagaugagagguuuauuacucaguguggauuguucccccuacaagucucuaaacccuuccaguagcccuguuacuuggaaacuccagcucacccucagauuuuauguugaauuugcaauuuaaaaaaaaaaucccagauugauuucaugguccagacacacuuucaaaacaguacuacacauggcgaagcuggggacaaauggacucaaaagcuccucugcucagccccgucagagacauugauccauccucuacccaaaauguuuacauucauaucaaaucuaggguuuagugaaccauaaaaguuagagguuaauggaaacaagaauugaccucaaaacauauuucaacugauuuuaaaggagacaaagcagauguaauuacggaggagaaaagugucacugcaccaugccugccccaguguaaucucuguccagccauccuguuagcuacacgcacgcauacauuccaaguacacagugacauugccagagcacaauugagggcaaccccgucucuucagaccauuagaacugagagaggaaaggcauaaagaaggcuuaucuccugaagcacuuucuuucucagcuacagcuucacuugagaucuugacagcaagcaaaacaauuuaguaaugucuucuuaaaguggcucaggaggaggggguaggaagauggcucuguggggaaacggcuugcucugcaagccaaagggcuugcuuuggaauccucaccacccacauaaggagccauguguggcagcauauaucuuaucccagcacuggggguaagggacaagagggccccaggagcugggaaaccagugaagguccagugagggacccugcucacuagacaacugacaccauccucuagccuccacacucgugcacaugccugugagcacagguuuaucaaaacaugcaugugcacacucccacacagcuuuacaacaaagugauucuuuccugauuguggucuccacagucagauucugaugagacguagcuauugcuggaaaugcuugcuuacacagcucuugagcuaaacagguaggggcucaccauguccccuggccccgcaaugacuccacauguaaaucacagauugcagugcucaggauccuaaaaguccaaauauaauauaggagcugcauuacauuaucaggguucagugaauaaacaggcaaccccaccucuaccccagugcgauaggaauuuagcuucaauugagagaaaaacuguauuuuucuaauuuuuugaaacuacucucaguaucuguauuuccugauguauauguauugguuguugggugccaauaaaaggguugucaggaaugaaaacaguuuuuucucuuggagucuacacagaggagguauggccuuggcugguaaugcacacagcugagguaaaacggauugacauuccaugcggugcugggucuaccgacagcaacuguccuacaagcuuccuguugaaaugagaccguuuggguggccacuacagggaagcggucugugucgucagcacagcggggaguguggcgggacaugacgggaugcuuccgugugucccagcugucuggaagcucuuuccuggacaggguugcucuccugggcugcagggcagcuggagcugggugcuacuccucuugcuugccuucacuuccuaaagccugaagcucgggugcugaggauagaccaacaucccuaucucuaggucucccuuuugagaugucacaaagaauacuauauauguagucucuauuaaaaugcauccuacugccucugcagcccaaguacuaggguuaaagguguguaucaccacaccuggccuccuucucuacuuuuuaaaauguggccaugaaugugugucaucucaugaugucauaaaaauguggccuguuauuuccugccuuauagccagucagucaugccaacagacugcagggcagacuuuaaaacacaaaagcuggcccccaacacagugauggugugcaguguucuacuuccuguuugacuguuagcugaaguucacucauugcucuaacuacagaguuuucucaaaccaaagaagcagcccucccuuagcauagaaccagcuaaaguucuccaauagcucugagguuugcuagaggaagccgacccccugccaacuuacuacggugagagaugaauccuagagggaggcuccagcugcuuugcaggccccugugcuucucaccguaagcucucuccauggcaggguauacacauuggcuccucuccuuaucagccauuucugucagccaguggggcuuagagaugcuccuuugaggggaauucuagcuauguaaacuccaaauaaaugcauauagaagaggcaggcgggguggaaaaacaacugugaguguaucagagggagucgguuagaggcagagcuggcagaggaaguacugguacugagcacagugggguaggaagugcugcuacuaagcacaguggcgcuuauacugugaacacggggucuuugaagccugggagugaguuguggugagacuggucuguuuguguagcucaagaugaaaagaagggaaaagagucaugucacggcccccccaucucagucuaaagucacauaguccucccuacauaggucaucacugugauaauuccugucaggaaaauccucuugccacaggcugugggugggagaccgcuuggugucccgaaagugagcaguggcgcuucuguguacucugaacuguucauucaagccaaagccaggguucuuucccacuucuccgugcuauaagcagcuguuugcuuuaaugguggaugguguguucccaccugacaugagugccucuagacuaucucaggucugugaauugcauagcccuagaguguggccaucacagggacccuucuccauaugagguucaccuggauguccuucggccuagauucuguuuucuucguccuggaauguuucccggcuuuauucguucaaugucaucucuacauagaaggaguucccccgcauuccaugugugguuugaugcucugggagacuguuugcacagcagaugcgugguggaucuguuccucagccugccgagugguuuccagcuuucaacugcugugaauuugauaaguguucuggcagagauguguauguauacauaaaucacuugauaaguuuucaggaaaauagcugcccuggggccuggagaggugagugugguuuagaaugcuccugaugacaagggugucgcccagggcaacuuuauaugaaugaaugaaguccuuccugcuugcaggcaaacugaggugaugagaaagacaguguauccuuagagagacugccaccaaggcaaagaaaaggacagauaauggcagccaaagcccagggguggcaaaggcccugucucugcugcuauugagaucauuugcaucugagcgccccaagagugaguguccucuggcagcgguguuguggaacaaccccucacuuggaagagcccagaaaggacucaagcaagcuucagucuaaaccaucaucuucaccuuugcaaaguuagcucugccaguuaauucugccagguuacaauaugcucaggccuagggcaagacauauauaugaguugugugcuuuaaagguagcaaccaaaggaaaacucucuuaagauuauuggagaacagauuugugccuuggaaaaguucuuugagaggaagcuggacgcccuggguuuuuagaugaaauacgccacaaagucacacgggacaauauaaagacucuucuguguucucucaugaccuccugcaugcuucacccuccagccuuugccugucuccuggguagagugagcgauggugcucuggucagauguagcuacugcacuauuaaaccccugacccagcuaagucucauuacuccauguuagucuuuccaggaugagccuguauccccugaaauccaugguguucugcaggccgccagcuguacuaaggacaggcuagagucccagccacagagaggaagacccauggggaugcauugauuauuauguagcugucacuuacaggccacuagggagaaauggucaacagguagaagggcagaagucacacuguuagaagauggccacugaaaacauuccuuuacaaauuggccuuucugaacuaagaacuagaguuuaagacugucagcauaccuagaugauaaacuggcaacaggaucuucuuuauuuggggggcuagccauguuuguugggcagugauucagaacacagaagcauaggaacaaagggauugcuuuauguagcucagacuuaugauggccuuuucccauacuggaauaaguccuucuguuccccuuucucgagcugccuauaccuuaacuaaugaggcauucucucaguacaaauugggaguaaagaauauuuauauauucuacuuccucuuuccucauauuuuuacugaggauauugacaugaaaacaggaucuuuguggcaaaugaguucauccacggcugcuucccaccagaaauucccagcuuugugacaucagugagguagcugugggugucacuucaagagcaggcaucugggcaugauggaaccuugaacaacaaaguuguuuucaagagaacgagcuggagaaggggaaggaagcugaacuucccuggguuccugcuaugcucaugucaucgucaucuuaaggcacaugcagacagcacccugccaggcaaucccugcccaagcuaacaaaccucgugccggagcuaagcgauucucaggcaccugucuccuuuacaccauggcacagccgcuuagaugccuuucaccuggcagaagguuggcagucugagcagaugugacggugucuucuagaaaagucugugcuuguugcaaugaaaaugucaacacgagguuacuuuucucuaaauaccugaaaaaaaaaaaagucuaaaaaccaucuccagaguguuccgcccuauuguauccaaaugcuacaugcuauagcucaggcuggccuugaacuaccagugcuccaaagugcugagguuacaggcaggugaaggcugaguguucuuuaugauagcaaaagagggacaggggcaauucagacaaggaugucuaagaagauuagaaaugaugagagauuacugcucagggccagggaguaagugaaucaggagcagaacaacaacaaaaagcaaagaggguccaacugugcagucauuauucagggggucagcaggaaggcuaccacauuagcugugugacaggggaaagagggaaagccacagaaaacccagccacgaucaggaaacgagacaggugugaggcgggaaacagaguaucucagugggucuucaagcucaggucuguuugccccucuguuagagaucugcuggucucugguucagacugaccaacccccuaaucuggagccugacccuacugccauuguuucccgccuggccugugagaguccagugcauacagagacacuguuacaagcaguggccugccaaaacauaaguacauuuuuauauauaauaaaauugcaacauaaacaacacagguugggggaggaggguguagccccagguuuaauugcauuuaauaagccaaacaugaagucuuuaaaacuuuguaaacauguguuuacucccuucuguauuuauuuuauguggaggcuagaggacaacaguugaaaauugguccuuucucuguaccaagugggcuugagggauggaacucagguugucagacaagcuuagcggaaaacaccuucacacugagcuaucucgcaggucacccuguucucaguacuacagguagaugccucuggagucuugguaguuaaaaucacuuccguuggccaugugccugcuuuauguagcaacugagcucagcgggauuggugacaucacagcugaacucuggggcugaucuuugugaaggccuugcucucacgugguguuugcaaacagucaaauggugagugauagacaggcugugguaacgugauggccaugaagucagagcgcauaaaucauugauauuucccuguaaauuucccuaguaugggaugaauggugagggaaauguauugucuuuccuugccuccucuguagccucagggacuucuuugcaggcucuguccugucaugcuuugcagggugaugagcuauggauauccacucucucuggcauguuugacccuuagaaaagcaaguaauucagucacuucgugugucagcgauauugcugaaguuuaggggcugaacuuuguagaaguggcaucaagagacacugaaauacuacugcaugggauuugaagagaagcauagucaacuucuccuuggaacaaugguacccaacagauuccucauugugaucuguagcacagaagaguagaaagugauccugugugugccacaguaucuggguaggacucgucccaacacaugaguacgugucacaauaaauuucagcuugaauguacguuuagaauccuugagagugaaaugcuggggaaucccugggguagaaucagggaaaauuccauagcgcaaacaauggaaaauagugaggcuccaucaguaauagcccuguuccuuuaugccaaacuucaugaagccauccaagcacacagagaucuacggaacugucugauacccauaucugccacacaguuugucaaauccuaauauuuuaguauauuuauuuccgucuuuggucuuggugaguuucuuuagugguuagaaaggcuugcccgguuaugaaauaaagcuuccuuuuucuucauccagagaggucacugugucugcaagcaugccuguacaguugaacauacaugugaaucucaagaucgccccaagguugcccuguggcuugugaggaggguggccguucucgcuggugaaagguccccugcuuccagcuucuggcugggcagaagguggccuucagcgcuugcuaggaaacaagguuguuuucugccucgguuucuuccuaaguuacauggcaauaguaguugugacccaggaacauugcugagagguuaaaugacaauuaagaguaccuuucuuagcuucuagcagaugagcuaggaugaucagccagugacagcaggggcuaaagguauaggcagcuugaguccuuuaugaaggagucgauugcaugcgagugugagucuuugguuuuguuuuuaagauugacuuuaauacacauacuauuuauguguauuaguguuuuaccuacaugugugucuguacaccauguguguucagugccugcaggggucagaagaggauguaggauccccuggaaaagcaguuacagacagauuuuagcuacuuugugggugcugggcuuugaauccugauccccuggaaaagcagucagugcucuuaacuguuaacccaucucaucagcuugagacugugaaucuugacuauuuuuaaaucccagagggagccaacuuagcagcagucccuagcugucagcagcucagagggccuccagagacauaccccauugccaggcaagcagcagaggagacaccuggcaggggacccagucagcuccaggacacacuuguuaucuauaaaggccauuuaguaauucagacaugugauggacaaaucaaaguccauuucucuuuuccuuuuuuaaaucaaguucacucuaauauuugagcuaguuuucuuuuuuuuaaagugucuggguuauuucucucucuguacaugguuuggguguuuuuuuagagaacagagauccaugcucgccuucuuggugagcuuguaaccuggagcccugauuauugagaggagugccuucgcugggugagggcuuaucguggguuccuuugcuaccccagguuugauuugaacgugaccucgguguuucuguugugguaaagcugagguuaguucauagagcuaugcaaggggagguuaguguucuugugugaaaccauuccauuaaagcacaccucugguccucaccaucuuuugugacuguguguugugaaaggaacucgagccaccacugcacucugcaaauagccagagcuucuaggacaguucuguuuguaguucucccagagaguucacaggcacacuuuucccuuccuucagugccuccaugacuagcuggcuagguguggugaugacagugcccagaggggcugagcacuuggcuucccccaacugcucaucugggauaucaucuacacaggcuccuguagcguucuuaguuaaagauccucuuuuuaaagaaauaacucuauggggagaugggaucaguaguucaaagccagcucacgcucccaagccucagcuacaugaugaguuugaagccacccuggguuuuguaaaacccuguuucaaaaauaaaaaaaaaaaaaaaaagccuccccacaucaccaugggagucgcuauggaauuuuacccuagugcucuuugcccucggguccugggagaggacacagagggcuuccacucugugggaccaugcuaauuuuuccaaaagacccacuucuugccuucauggaagaucccagaccauaacuaagaugcaaacugucaauccuacccaagugcugaacccauuaauaagcauagaagcuccucccucagcaaaagacuuccggauguccugagcuguaggaucggaccaggucugcucccaagcauagggaagaguaaggcuggggacaggagauagcugggcucugcugugaccaagagaugggggccacacaaaucugagugaggugagucaggggacccaggucuucagagaauuauugcagcugcuguguugacucagagacugucaagaggaggcugccagggacgagagccaauguggacaguaagagaugugguccggggagggggugggguguuuauuuccuccacagaaaagauucccaagaaagcguaugaaagucaagugaaggaugucaaugauaagggauagcgcggacuugagaacauuuagcuaacccagucauguuucagcguucugcauccucacgugcacaccauacacauacacagacaucucuccuggcuccauggaccacggugagcucuaacauucacguccaucugggaggcuauuggaagauguucugaucuuuucuucaggcuucaagcccagcauggccucaaacaaacugugccuuuaacucugcacucugugccucucgguuagaggucucaguucagccucagcuuccccugaagcucagccagcugcuggauguccauagccccuguccuccuuccuagucaaggcuauagacagacaaguaacugagcaguuggucuguugggauacccagcaccucuuagcuggcccuaccaccaaagcauaaugauucaguuuccaugccaggcuaagggagucuaacagcuaaaauagugggaggugaacacccauacaugauggccaaggaagccagaagccuagagcauuguggagagugguaguauguaugcuagccccuggacguggaugagguuaucccugguccccaggagaaagcuuugugacacuugacuguauuccuaccaugugguacccagcucagaaggaaauagcugccagcaaacuguggcacuaguugaauccaacugaaaggcaagcucucuugugcugggacuacuggccuacuuccaagacaauauauuagcaguggacacauaaaaugacuaagacucagcugccaaguugcagaaggacaaacaguaaagaaagaaaacuccuguguagaugcgcuggcaagaauuagcaauuaauugguuugcaaagaaccuaggcaaagcuauaguuuacuguagggggucagcacgggaacacguaugcugccucccuugugguuucugguaacuccuccuugagacucaguaugagcccgauaccagcugcugcaaaggaaaauguguccacacugcgugugcagagcaccugguccucagaaggcucccuccaugucaccuuuauaucaucccugucaacacugaaagaaaaaccugucaggcagaguucccaggacucccauacccaucuuaucaccagauacauggauauucuauucacuguggccacagauaacaaaugugucucaugagggccuugugccagccagauccugcucugccucgaaacacuggugguggugcaaggauggaaaguggccaacagccuggagugcuggaguuccccacuagacccaaacagcuacucccccugagcauuccugaacuucuccuggggccuguuacugcuucagucagagccaacaagcugagagcugguuccgggaaagaccugggcagagagagcccuuuggcuuuccugguuuguuccucucuagcagcauuugccucagggaagucuugacaccucagccucugccaccaucaagccacuucugaauacaguuccuuccuuaaagugcauaccaucaauaaugugaccacccaaagucucuuuccggagaagccccucuuaggccccuucuugcaccugucucucuaaacuguaagccccugggaaacaaaaagcaaacucuuggguuuuggacucugcacucuccuacuccggcaacacacaugauguagagccaucuccuaaucagugugcauugaguuagguagccucuuuccagaaugaucucauccuuuuaaaucaacauuaucucaguauuucagagcccccucaaugaagggaggaucccccacaugcaccauaaacacaacuaugaggaauggacauaagagugaccaacaugaggcccagucaagacccucagugggacccuucccaagacaaagcuuuccaaagguccacuugaugagccgggguugggaaagggugucuguaguguagcucuuggaagggacagcagcagagccccaguacagaacaagagugucagagcugagggcccaggaagaguguggaccagcuccugcacccccacccugugccuccauuccucccccugacucuugccaggagaauggccgauagcuguaaggugaaugucccuggagagcgcccuugacaguguaaagcagaguucucccuugagugaggaagccucuggaagaccauuucagcuucccaugcaagagaagaagaugaaaccucaucucuugcuauucagcugaagacauuggggcauguaggugaaacauggcuugucagugaccucaggacagcaguaguaucagccaccauaauccaucaucugagaagcaugugagagugugaccuuacugugggugccccucugcucuguagaacuaagagguaaccagcacuuggagaauguggucagacuccuuagagacagccccagcuguggcuuacccaucaaaugugauuuagcuugugacuuugcaaaauacaguguguuguacaaacucugccuggggagaugugaacagaaacauauuuaucucccagacaggccaccaaucaggcccaagugaugagaggauaccacucaaguccagcuuggaggaccaauagaaugacugcccuugcuuaaaagaaauguggguaaccccaagucagcuacauccccagaaagucucagucuagcauggaugcuccauauggaugacauguagcugcauagacacauguguggagcucucauacacucacuuagcccucuguguaugcuagcuaccacuuccgaagaccaggagaccaugugcagccggggcagaauuaaacaggcugggagcuagacaccagagggacaaguggaacucucagguacgggucccauaacccuucccacugcuuccuucuuguugguaaugucaaugcuagaaccuugagguucucuugugaguggucacaaucucucugguuaaaauagcuguuaugcuuggaggacagcaucgcacagcacggugcuuuaugaccgaaaagcaaaaugcacaauugccccugcuuagcuggggacagagagaaugggguacagugcugcuggcuucuagcuacuuaagcuauguauuuuauaccccaccccaccccuggcccuauuuagaugauauugcgccaccacgcccggcugauauuucucaaaguaaauacaaguggggcuuuuaaaggucuucauaaaagcgaaaauguaaagagcuccugggaaaugaggcuguccuuucaacuuggcuuccaacccacuuccgcagucauauaaauaggaaggccucuuccucguuucaauaucuuaaaaagaaaccuugauguuacguguugaccuaagaggaaugccuuccuccuagggcagacggaaggauauucuucaggaaugcgaagcuugugacaggaauuauugauaccuuuggaauuuuuucccaagugacucagggcuucuucaaaccauuaccuaggaauuagucagggacugcgugucgccguccccaacuguuuuaaagcagagcugagcacagcguaagcgagaaaggcgcgaaugugccuuugcguggucuucccgcgcugggugacucuuguuuuccugcacacuuuaauuagaauguuucuacauuugccaaagaaaauguuggaauggagacaaaaccgugaaauuauaggaacagggcuugauguaauagcuuauuugugaaggaagcacaacuuguuugguauuuuauugaagcaggaaguucggagccucagaacacacaagcacaacaaauucucaggugccgcuugagucaucugcuguuggcagcgccacugguagcuuucccugcgcugacuuuuaucuucugguuuguuuuuucuuuuuugcagagucacgagggucaggugggguaggaaaugacacagagcuuuaaaaagauuguguaauuuuuuaaaaaaauguacagguuguguacauuuuuuaaagauaagcuaugaggauuaaacagagcaggucgggcagccuccccuuaaccauauugauacuuuuuuuguacuuaucaacuuacaaaacaaggaaacgugaaauaaaaugagaaucugccugaaaugguaacugucgcucuggggaaucagggaaucguauagagacaaucaagaugagaagcgcugugguuuguuucucuguuuucuauuggcuuuuggccacgggaacugaaugauagacccacagcauuaaaaaguuugagaaauaucucgggcugacugacaccguuuuguuucauaugcagaaaucauugaguuucugucuuguuuuuuguuucugucugaaaacucgggucuagauggugcuuugagauguguaaaaaucuccagccacccuggcaccacaugguggguguauuaaauaccugugaguuuucugucaagugacugcuccugguagcacuugagugaagugcugggaugggauccgauggagaggagggagggagggcgggggggcggggauaagggaaggcaggacccagguccuaucugaauugcuguguauccugcaggaugugaggcuggugaccaguucacggcuaguaaccaagccuguguggagacaggugacaaggcagagucgugccucaggaaggagcaugcgcagaucccacagaucaggcauuaacuaacugccuaagggcuaagagccagcgccagcaggguggggcuucauucacuaccuggcaugagggcaccuuccuggugauacuugagagauuaucucucugcaggugaaaugagccaauucaaagcaaaguagguuauauuaaaugcagauuuauugagacucugcucucucauaaagauaggugaguucacuggcccccaagaucuaaggccaggaaagucacuauggagaaacagagggggcggagcauacacacagagagagaaguggagaagagagaggcaccaaauauccuuuaucuauauaagauauuauaugcuaauuagguaugcuaauuauguaugcuaauuagggacugagggaugccaggcaaccuuggggccaggucugcuuugguauguaaaauaugcaccucagucccuugucagaguccaaaaccuuuguucuucauguauaucccauuauauaugaggaucacugccuuuugcuuucuguaugccugacucugcuuuuauugguccuuuaaaugugucuuagaaaacagacaccaucaaauuccacccugcugcuaaauuuccucuuguuggcagguucaaggucaugccagaguauguggcauuugaagugcuuucugacccugcucucugccaguuacagcucuucccuucuuucucccuacccacacuagagccagccugcccucccacaaaccauagcuucuuagucucuaucgugaaccuugcccugccugucccucuguacaugugcaugccuaucauacacacaugcaugcacauauccccucagcaugugcaucuccguuguacugcuagucccgaguugcgcuggagaagaaccacucccaccauuugaggccagauuugaagcaagcuuuauuaaauauuaaauacugaccaagagauggaugucagucaggaccacucccuggaauuucccagcugggaaauuaauaacccucugagggguuuauaaagacaaacccauaaacuaccauacuuucccaugaggcuuuuguuauaguccaggaacuccaacucgaagcaucccaggagauuacgccccgggcagguggggcuuauagguuaguauucgauaccucacuugugugugcucacacauacacacacacacacacacacacacacacacacacacgcacgcacacaaccacaggacaagcauuccccacacccucagaaggaggaugugaauauuucccagauguguuguauguugacauuuauaugaagagacuggccucccugaccccauugaguguuucuaugugccuccugcuagauugugugcuccuacaagcaaaaauauauauguuuccccucuccuuuuaaauucccuacauuauagauugggcacauccuguaacucuuuuugaguuaaauuugaaucugacaggagguagcaagauugcaaauacaaugugguaauuaaggauaaucagaguccuuguacagggugacuaagaacaguucucacuugggggacaggaggucaaacacccgaagccuucugcuuuauaugucggaauuuggaacagcuaccucuagugaggacuuccauagcaaccaggugcuggcagauaaagacagaccugauggaggcggucccccaagcagagguacccugagaugcugagccacaguaguggccauggaaacagaaggaacuggguuugacacuaagggaaguccagggaccuggagggauggcgccagcucugcccucccacuccagccccaaagugggaaggcuccugcuuugcaggucauuuccucucccuaaugugcagugaauuccugggcagccuuuguuguuggcuggcuugguuugucguuuuccuuguuguuuacaaccuccagguauuuguagacagaucuuaucuccuucccccuuagucaccucuuggcccaacucuguguauuuuauucuuuuaaacucugcuccuggcuugaccuuuccacacucucugaagcauguuuguuuuguguuuucagaaguuguucuacugggacuauuuuaagagaugcaauaaacuaaauaaaauaaggccuggcccagauaagaaugauggggggggggauauugaaauguguuuguaugauguauacacauuaauaucuauaaacacgcaugugguuauguguguuguauuucuguaugcaagcauaugaauauaucugcgugugugugugugugugugugugugugugugugugugugcccgcgcacacacgcacuggugcccagccagucugcuaugaauacaguguaccacuccugagagcugcaccccacuuuuccacugagcauugcuauagccugaauucuccaaucuucccaggaauuggcccauacuaaauuguaugacagacaagacauugauacccauguacccauggcuccacuauagaaugcguccaucucccucugugaggcugugguacccauaagaguggacaugaauaugguguuccaguggaccagcucuguuuugucuugggcucucucaucaccagcagcuucagggguugagauggagagggacugcaaagggacaugaaugcugucucuaggauggaauggucuguuuuacuugaaagcuguucuuccuuuugugagaaucuucacacucugauaccuuuaaauagugaguuuugugguuuuuuuguguuuuggguuuuuuuugggggggggggcuguuuucaagacaggguuucucuguguagcccuggcuguccuggaacucacucuguagaccaggcuggcccggaacucagaaauccaccugccucugccuccuaagugcugggauuaaaggcgugcaccaccacugcccggcuaauuaguggggcuuaaugccuguguauuaccucagcuaagcucauucuaacaguuaagcauacagaaacagacaugucacuucagaauagugcuucuguucuucaccuguauucauguaggcaguucauucccucaauaacugugacccuugccagagaccccaagauugggcuucuugauuuugcuguuucuuucauagcagguagagagggucacuggagccucaccugauuccugccccucccuccugaaccucuaggugcagugaaauguccuccuaaguuggaguugauccucugccuuguugccuccaaagagcccuggcccuggcucaggugagcuucaucaccacuguggacagaagcagaaaccaggacauucaggcugucuccagugcccucucuguuuaggugcaaauauaacagaacaugaugugacugucugaauucuccgcugugcucuaguaauacagucaaagguugguggcacacgccuuuaaucccagcacuuggggagcagaggcagguggauuucugaguucugggccagccuggucuacagaaugauuuccaggacagccagggcuacacagagaaacccugucucgaaaaaaaaaaaaaaaaaaaaaguuuuuuuggguuuuuugaguugucaauagaagcuuuugaaauaacugggaacaaacaagucauuggauagacaggaaugagagaagcggucaugaaggaacaucaaacccagccauuaaaauagaauaaaagccagaaacccaucccauggccucuucgauucacagguggagugcuagggacuggaggaauggggucacaccaccagugcaguguguaugccucuccugaugucacugugucugugucccugcucccauggcugcaagccaguggagaugcagaaagggccagacuccccucacagucccccccacccccauaggucucagguguaggagcaguguguauuccuuccuccagauguugguguccagucaggagcucuccucaccagggcucccuggcugcucaguugcucccccuccucccaugcuccucccuagcuuucagcggcuggcagcagaggcacauguucacccugagggagcauuccgaaagguggcaaauaaaucguggaaaugaacugcagagcagcccugaggcgugcagcaccggcuccucaggaagacaacagcccugcugugaauggcuggacagaugccaccaugcucugcccugcaagcuuagauuaccacccaggugacaguuguggccacuggccugcaucccagcucaaauuugaaaaaaaaaaaaaaucacagcaggucgccuuuguauuaaaaucuuaaaaaguguaguagucacugagcauuccagaaaggugaagaagcgggaaggaucgggccaugccucucucucuucucccggagacaugucucgugacuaccucaaggugugaccucuacaccucaguggaaggaacauuagcucaugccugccuuauccacacuuaugcaugacuaugcacgugccauuaaaacuaagcaugcaauguauccugaagcaggaggaaaaaucucucacaucuccacacggcccagcaugcacuuggcaguaggcauccagaucacugauagaaaagaggagaccagacuaaccacucaaagucaggucguguuuggucccaaggaagcagagagggaccauggcucuugcaggggacagaggacucacccaccacaagguuaaccagaucccaaagcaggacucugacaucaacauaacuggcuggcaagccaggaagaauaagcaggcuguggccauuaugccaggaaugagagcagcucaucaccugugagcagucauccaucccaccccagugcccacaggccagagcucacuguucagggcagcagggcugucuaaguaucagagauaacccagaaaacacaggcagggacaacaaggguguggagccgcauuauuuaccgggguggcugaugugccugggccugaggugggcugucuuuguggauguucccuccugacucaagcuccucccugagaaagcaccuuuaccccuggaaggugauccagugcagccguggcuucgugauaaggugcuuagacaggauccucaagcucacuguugagcuauaaaauagaccuguccacagucuagagccagccuggcucgucugacuccaguuauucuaaucugggccuucuauggcuauagaauaagugggagauuuugguaaggccugcugcuggguucuuagcuccuuucaucacaucagaggggcuaggauacaaguacuucugaaaucuccugguucacaaacuucaucugccugagcagccuacucaacucagcuggggaacaaugucuaaucuuacccacacaauaaucugacuuccuugguguagagugggccuacagcauaguucugaggcaguucuaauagccacuuagaaugagaaccacucuauagaucccuaugggacuguugcacgacagcauuuuuuuuuuuuugcucagaacuccuuccuaacuuuauguguacucccagguccaccuaugugaggggaagguauaccagcauauacauguacacacacgugaaggucaaaggucaguguccuuccggugucauuccucgggagccauccaucuuggugcuuugagacaaagucucucacuggcgccugaacuggucaguuggacuaggcuggcuguccggugggucucaggugucucccugucuccucucccuagcacugggcuuacaagugcaagcuaccauacucaacauuuuuauguacauuccaagggaucaaaacuaaguccucaugcuucaggggaaagcacuuuaacugagcccucuucccgacacccagaacuccagacugacuuccuaauaucccauguacaugccuggggcuuuuaacugaucuacggggcucuuacuguguaccagacaauuauucacuuacuucagugaggcaaacguacaccacaugcagugugcuucuggaggucaaaggacaccucggagagguugguucucucuuuguaccacgugggucuuggagaugaggcuuggcagcaagugccuuugcccccugagccauccgccgacggccauaccagacaauuuuugagggcucaaauaaagauucuguaaacccaaagagugauauccauauguguuaagauuucuaaaaaugagaauuuaaacacaagguuauauagaguuccacgccacagaauaguucacauuaguacugaacuaauguauggagaagggagcuucagaccccugaaggggagacccuggcagguuucuggcgaaggauagaagcuggcacacauuuggaaucauaacacguaggguacugaguccagggaggguuggggcaaguuccaggccaggcuguagcgugagacucuuauaaaaaaaaaaaagaaagagagagagagagagagagagagagagagagggagggggagaggauagggaggggagaggagaggagaggagaggagaggagaggagaggagaggagaggagaggagaggagaggagaggagaggagaggagaggagaggagaggagaggagaggagaagaagaggagaggagaagaagagaaagaaagagaagaggggaggggaggggagaagaccuaccuaacaaguucaaauucugacauacuucuugcaguugcugaacacuccaagacaugaacugcagauuuaugacuuuuugaaaguuauucguggauuccccagacagcuauguucccaucacuuaugcagcccuuaaaacucaaaugaugcuuuaaaaacccaagucuggcacacaccaaacccugacguugaccguuuugaguagcauucggugaaagucaggaagacacuucugccuuggccaacuuggucaucaucacggacaaccgcaagugucauuuguucaugacucuuaaaaacgaugugccagagaccccucccucccccuucccccuucagcaccuuacuaugccucuuuuucauaaaguggcaguuuucagucaguucugucagugaguaacagcccuuuugucuuccuccacaguacauagacucuguucacugggacuuuccucagugaaguaaugccacccacacaccccagguagcccuggacugacacggguuccagggcguuuuacuccccaacacgccuccucuguccucaccccauauuuuuuucuuaguaugcucauuggauuuuuuuuuaucccuuuuuauuucaagcuaaaaccaaggaagauuauauaaacuguacccucagacucagcaacacgugcucggccugagaccauggcugccaaggacauuaaggcccucuaaaucauucacacuauugucgcuggccuucacgucuccccgccuugacaggcucucaucucccagucaucagccuguuaaauguccccgaguccagcccucuuaaccagauacagauguucaaggcuguguugcuacugcauuagaggcaaacuccccucccaucccuccuuggagcucagauuucaggacauagccuaagcugcugcauuguguuguauccggaguucgcguuguuaucagcuuaucgccuugggaauucuuuauggaucaccaucugaauguugcacacacauacacuuuugacucaucuagguaccacagucuugcuaucaaccaguauauuacucuuccuaauucagagcacugaauugaguugauccacgacuuggcacacauucucaaaggauucagcgguguuaggcagacaucagacgacaagacuagcaggauuaaggauguucucccccacgacucugggaggacaucaccugcaucuuggcauacacaaagugaagcggucucacggccugaguguggaagagcaaagccaccauaugaauuguccauguguuuaagucccaaauuaaugaggucaagcuuaaagcuugacauggaaguauaaugaauuuagaccuuuuggaagauuuuguuuguggauauagaauaaggggcucaaauaucucagacaccgucaaaaaacuuauggcuagaaagacuaucaugcuagcagaccagacaaugcuaauggcuccugguagagcaaccaugucuuuaaggcacugugcuguguagccaaggcaugggcucuacuuacccaguaagacaggcaugguuugaguaccuccuaccccauuaucaauaugccaccuuggucaggaugccuuagacuucagucuuauuaacugguaaaugcuguggguaaccauuuuuuuucuucuucuggaaguuuauaacagcugggcauucuguuaaaccuagagugguuuagcagguacacagagugcaaauauuacaugaauguaaaugaguggaagacugugauaauaagaccacuggcauuucuugagugucugcauuuccaguuuugcgucuucaaaaguagggagucaggagagcugagcgcucaccaaaggccacacacagugacagcugagauuuaagccugugcccuuccuggagcccaggccuacccucucucucaucacucagcuucugaggacaagagagaugcugaagagauaauagugggcauucuuaaugauuucucaauggaaguuucaagguggccacaggaaagaagaucagauaagaaacaagacaaauucgaagagaccauggcgacagacuucaggcaucuuuagacauguccaacagaagccaaaggcguguggagcugaaugagcagagcgugugcuagcuucauagguuggccuuccauggaaauuacuuacacacgugcacacgcuggcacaaagaaagaggcuggagugggugggaagugccaguguuuuauuggcugguccuccucugugccacaugcugggugcagccucuagggugagggagaacuacuccguagaggucccuagucccuguuggagaagaggcuugguuuuauucacucugugacuuagugcccuucauguuccuaggccuggaaaggccugucagcagacuacuauaaucccuuggaguagagcauucuguuccaaaugcugaaagcucugaaaaaugcuuuucauugucacucugacuacuuuuaagcuugugugguugugguuacuugcuaaguaauuuaugguaguuguuaaauaagcauuuuauagcccagagccuagagaggagcugugaguccuuacugagauuugugcagaaagcccagggcacuguaccuucacauucaggagccuuuagccuugaggccacugcuuuccugggcuuccuacugugcccuuggcagcagaccacccuuuagaacucucccuccuccuccccuugccaccuuucuagcuuggggucagcucugguugucugcuggugucucuggccugguuaagccagucaguccuuuggcuccuggcagcugaaggggaagagcugaccuggcucagggcucccugcugagaaguccuuucacuagugagaaaucacagcaucaccucaguacaccuccaacuaaaggaaagguuucaaguucaccuccaacuaaagggaagguuucaaguucaccugcuuugcuguagcccauggccuucuuggccaggacagaacuggugugaguuugugugucuguuggggguaguggggaguacuagcccauuuaccccagcuaagacuauaagacauggguuuuuuuuuuuuuuuuucaccuuuguaauucuuucaaaaaugccuaugugcaauguuucaaauuaaagacuuaaaacuuguuuuguuuguuuguuuuguuuuggggguuuuuuguuuguuuguuuuuugggguuuuuuguuuguuuguuuugguuuugguuuuuuugagacaggguuucucuguguagccuuggcuguccuggaacucacuuuguagaccaggcuggccuggaacuuagaaauccgccugcuucugccucccgagugcugggauuaaaggcgugcaccaccacgcccggcuuuaaaacuuguuuuaagugccagguuagaaaugauggugucuuacuaucaguguugucuccuaugcacagaugagccagaggccugcugcccagcugugagcugcccccagagcauaccugugggucaugaccccuuuggggcuggaaccauccuuccacaggggucgccuaagaccaucccauuggcaagcacagauauuaacauggugauucauaacaguagcaaaauuauaguuaugaaguaguaaugaaaauaguuuuuggguuggggaucagcacagcaugaggaaccauguuaaagggucacggcacuaggaagguugagaaucacuggucuaaacucacagacuccgugcauauagcacaacagcacugaccucucuguggacacuagcuggguguuccgacauucaguccacuucugccacugucagccuggaguuaaagacaggccggcucccccugugugucagucguccucugacugagcagcugaaaauccucuccuaggauuugcuagccugcucagacagcugagaaaucagugagacgcuggauuacauucuucaguuuucuacaaacguaauuagagguacaauugaagagccuaaagaggagaugccagaggcaaggccugggacagaaacacggggugugugugaccauucucugcccucucugccguguucacccaccuggaacucuauagacccacaggcuagaacgucugcaaagcugccucccguagccuggauaguggcugacagcugcagcaucccggugaacacaccgacacggguaaccucauugauggguuuaggaucaccauggaaacacaaagcugagcgugucugcaaagggauugcuagauuaaguuaaguaggguggggaaacccacucugacugugggcaagcccugggcuggcgcccaggauugagugaaaagaaccgcaaucuggggcgcugcuuucaauucccugcuucccgacugcauucaguacaagcagugcgagcagugugaacaggcuccugccucugcaaccaggccugucccucugaaugggaagcagauuagaugccucuauucuuaaguggguacuugucgcagcacugaguaaagucauuaguacaauaucuaaagcauuccacccuaccccauggccugccagcugucccccagcaagcagccucuucaggccagcuaccuccccugccucuggcuggagagagcuccccugccuucucuccucacugccucugguucuuugcuguuaauguuccccaagaucgucuccuccuuuccccacgcagacccucgcccuucccuacccauccaucaccgcaauucacgcuuugaugccucgcuucaucugccauagccgucucuccucaugccugcacugagguaccccuaaagugguauguuuugcuucaaagcuggagauuucuugaaaucagaucccagguuucccacaguuacccaagaaauccauuaacugugcaaauguagcugugcaccacagcaugccagguguugcuggacgugcuccauccaccagugagcaauguagccauuucuugccuuugguuccagcaggagaaaugagaaauagcacccccgccccaaauaaauuaucuguuacauuuuagaaauuucgacagaaggaaaaguagaccaggcuuagggaagagcuuucugggagcccaggggcacccucagugcuuagagggcaggccuugaggacagugagagcugagugaccagcauggucaucuagguagggaaggaggacaucugaagcagagaggguacagugcaggagcauggugcagauccgggaggaguacggcugccugagaggccugagcagcgaguguaggucccuaggggcaagggcccugcugcugcccagugugggggcuucagcuuuugcucugcugaagugauacaccaucauuccgaacagaacagcuuacgauucugaaauccccaccgcagcaagaagagcugcuaggaagcgggcuagcggcaaagagaccagacauggugacauuagaacaagccaggcgggcacuaggguugugcugagccgcccgugcaaggcacuaacaaagaccuaagugguauuuugaugaggaagccugucagacccuggacaagugacauaggaaauaagaaaaggagugaggcaggcaguaagccugacuguaggguuugggcuucagccucaggagguguaggguuccccuuaacuaagauggaaagcugcagagccagcagaucuugaggagcaagauggcaaguuguggucaggacagagaaguguaucagacagucacacacaaggggaauagagcagcagguuggauggguuugugcuggacaggucugugcuagacgcagaaccuagacaucagcagaauacaaaggccccaagaggugauaguaucacccacugcucucauggcugguugguuguuuagcugguuuuaguuuggguuugauuuggguuggaguuuguuuguucuuuuugagaagagucucacccuauagucuggccuggaauuuauuguguaaugaguuuguugauggcuguguuaacuacaguccucccagugcacagucacguuggccuggugccugcuuacguaggcucaucacuugaccacuccuuaaucacucuaaaagaguuaucuuuucuuauuacccacacgugcccuccuguacauccacacuccagugauccuggacuauguguuggaacauccgugccaagcucuagacaccugucaccugaagugcccuggcuugcgcucccugcucugucuccccuacgaccagcucuucucugcccuuccuagccuacucagucucuguucucccuugaaugaaacauuuuaagguacucucacuugagaaacaaaguggacggacuaccuucccauucuugugcucucaaauauagccuguuacucuacugaaugaaugguagaaugaaugauugaucaaccagugacuagcaugagaaugaggagcaggcugugccacugccaguggcaccagcugccucuaagauaugucaagugaauguagugccuguuaggcaaggcucugcagaggaagagguacgcuguccuugaaggaaauaugggacauaaaguguaacucuggacaggcacaaucauaccguuuaaauuaacaugcagggaacugacauuuuucauauucaguucuaugaguguggcacugacgguccucagcagggaacugaaaaggccaugcgcauugguagaaagcuugagggacacacuuguuggccagugugcaugugaguguauuaguacacacccacccccagccccaggcuacagggagaaagcaggucacuaaugaagaacccauguggggucagaaggccugacccaagaagguggcaccaaguaaccuguccuacgauugcacacccaugugaauauucuagagacccaccccaguguaagcagagcugacagcagcagcuccuuaucaguuagggagauguaaagggcccuuguuccagaucucagauuacaccugauuacauuacauucuagucagaagaaucagcaugcaauccuuauacuguggaaggcuaccguggaaacgcagguguggccuuaucucacuugaccuggauaugugugucugucuccuugcuacuggugagaagcagaguugggaaaggccagcacuguggggcccaagcccuuugauucaaagccugauuguccuuugucuagcaaauggugucaggcauccuccuggaccuuuggcccuuuauacuguuuaccacaaggauugggccacugagaauuuagucgccacaggucuguaccuccucucccaaguguggcucaucagggaccugaauaucccucccaucagugagccacucagcaggugagcucucacgccaagugaaauccaaggcccuggcuauagugacugaaccaucauccccugccaaguuuuguuucuugaucauggauaaauagcugggauuccucagagcuagaagccagggcauucuguuccgcuccaacgguagucugccaugacugacuucuggguaaacagauuggaagggucugagcuaaacccuggugaaucaguagccucccugaugagggcaaacacgcagccacagggacugagcucucuaaagcacagcugauggccucugcuagccccgaacugucgcuaaccuccaccagccgcguggacugaagagcucagagaacgaagcaccuacuuuguggccauugcuccuucacuuauaugcccauguaagaguauauagauauaugacaaguaaaaugucauugcaucaccaucugcagagaacaucaggaacucuacugagaacccggagcucacccucugcacuuugccuguccuguuuauuuuagagcccacugugucagugaacuccauuaggugcuguuucuuccaagucuuuuuuacagaguaucucucuguaacuaaggccuuacccagacuccugauugcugggaugacagaugcguaucaucacacccauccuuuaucccugacuucugaggaaauggguagauucugcuaaacuguacucuguaauuuguccgugcccuucuuaagcaucugauucuggcucugguagccucugagacacuuugggauuccauaauugguaagaacugcuggaccuucaaacacugucuguugagaugaaauuguguggaagaggacacuuccccucccagcaagaaagccaguugaguccgggccaacauuccuaauccgcauguguccugcagucauccucucgcagauuucagcgagacacagucaugccggcuugguguacaggcugggaguuuuuuuuuuaaccuuuguccuucauguucuucacacgugggguguguacacggaggccagagguugacaucgguugucuucuucacucauuuccaagcuuaccaaggcaggggcuaaugcugaagcccacgcucacuacucuccucaucccaacgaugcucccacccugccccagcucucuguuugcugggguucagguucuucaccgucccaaaagguuuuuacgugagugauggagaucuaagcucugguccucagaauugcacaacaaacuaucuguccacugagcagucuccucagaaaaaguuuaggucaguguucaguaaucucugaggcccuuguugaggugucagcagaaauaacaucacagugaucacccagccaucugcucgccaauucacccucaucccgacugaccccacucccgucaucaccugauacccucaugccuguccagcaucuucucuuggguguguguguguguguguguguguguguguguguguaacacgugugaaguuugcagugaaauuggagguuaaggaaguugccuugaauuguggcaacaaaagagauuaagauggcuuugcaaaugaucggcuggagagauggcuaagugguuaauagcacugacugcucuuccagagguuuugaguucaaaucccaguaaccacaugguggcucacauccaucuguaaugagaucugaugcccuuuucuggugugucugaagacagcuacaguguaauuauauauaauaaguaaauaaaauuuaaaaaaaaaaaaggaaagaaagaaaaugaucaacacaagaucacuugggaugugagcuuccucucccucuaaagggauggggaggcuagaggagcacagcaagggagcacucccuaucaguggcuugguuucccuuuugugcaguguguggccuuaauguucucacagaacuugaaaaaugcaccaguuggggcaauggugccuugcuagaaaggaaggugaaugagccaaggccagggucccauggcugugccgaugaccacaugcacucaaagacauggggugcaucuaagggucuggaugcacaggucccuguccuugcaggccauguugcaguuuacugaaaaaaagucucagaggcugggaagaguuauaagggcccugagaagcaccuguuccuacgccuuccgugcaggaaggauuuuaccagagcuuagcagugagcacagugccagccaucaagguuucuguggcaaugagcuccuuguacaugcacgcccuaauuuuaguuagguuuggacagaggggcuuaguuacucuccucauuacuuugaccaaauacuuauguuugcugggacucgcuguucaaggggaucacuccaucaugguggggaaggcaugguagcaggaguuggaaggccugcuggucacaucgcacuggcacaggagaagcagagagugaacaggagaugauguccggcuguaaccccucagagcccacagccaguaaccugcuucuuccaggaaggcuccaccuccuacagguuccacaaccuucccaagcaguguggucaaccuuggaccaugagucugugggggacucaucacauuccggccacagcaaaaaggcaaagcacaugcaggcucaauggcuuugaauuuguaaaacaggcugaguaaauaaagaguccuaaucaguugacuuuaguauaggaacccugucucccaucauucaccagcaccccaaauaagcagcauggcaaauguacaugcuuggugaggaaagaauaccuaaccaaagaaaguagcaacuaacgccacauucuaagacugcaggggcucaguucucuagguaaaaccaggccgccuacugacuacaauguugcaagacagugaacuugacugcaugguuuuuuuguuuguuucuuguuugaaacaagguugcacauaacaaagcaggcuugaacucaccguauagcugaggcuggccuugaauuccuggucuuccucucuccuccuucaaaguguccagauuacauauguaugccagccaacccagaucacuuguugugguugcuuaaaaguaauuguauccuaaguguguauaugcucauuguauuggcauuuuagaguggguuaauauaaacacagcaaauccuuaauagcuguugagugagaucauucagaugguuugguaucuuauacacucauaauugguuuucuaguauacggugaaggaugugucuccguuugguuaguccagaacuuagguuugagauucuagacuugccaucuucccauucagccauuuuaccauguuccaagggcucaaugacugcaugugacccacauagacaugaccaucuggcucaaaggugauuuuagcuauaacaggaaaggaaacucuccccaaaucucaccuauucuuauaagcuaggaguaugucaucugcagaggaaaugagguugcuuggauugucuugauuccaucccaucuuccacggggcuguaaaugcccugcauaccuccauagcguccauguuuccuacgugccauuuuguaagaaaagacgcuacugaauuaauacacaacaacaucuaauguacaaaaagucacacuuuacuuggugucugucagcugcagucaacaaucacaguaauaauuauguauuucaauacagcuuggcucagcagcaaaacaccuugguagacaguggugacccugguuucuuugcguuugauucaugguguagauggagcaaauagaagccugcugccaguugccagucaguggcacacugcugaugcccaguauuauaaaacucaaaggaaaagaagagaaaagaaaauucauggccgaauugaaguauauugagugggcccuacugauagugaagcuacaguuucggagccgggcccucuuuuuacauuaggguuagauguggucaugcuuacauaaucccagcacucaggagauagacacagcagacagacagaggucagugggaauaugaaaagaguuccaggccucucuaacugacauagcaagccuugucucugaaacaaaacacaccgccacuguggugugcaaagugagugggaaaccaucuggaaguguaaacuaagcaacuuaguguccacggcuugccuggguuuucacccucugagcagagcccgagcguggacuugcucuuuuuaaaagaguuccuuucucuuacacuugacaucaaaaccccuaaucucccugagcuacugaccgcagacacuggaaaaacaggcuaaaacauucaaaauacauaacucccaguagccccuagauuauuucuacuuuagaaaaaaaaaucuuuaucaaucuguuauuaguaaaauguauuuuaaaauaaugcgccuucccacugucccuuaggucaaccagaugacacaacaacuguuucagacaguaagggggcucugguucaugugucuauuucucaaauacuuugcauugucugugacacuuguucucaaaugcugucucaagcacccuucaggccauguucagaaugacuccuucagacauuuucuagggcccccccuccccccaaucaggacauacauaccugcucucucugaggaacaucguccuuggaaauucucccuuuccuuuugcuaucucaccugauauuuaaucugaagcagucccagagucugcuagucacuugcgaaagagcccuggagcccccuaaguugagugauggguggcaaaggaaacaccagcagcaaauauucccccuuacccacacaguccuccaaguuacuuaaauagugcucauuagauguacuuagucuguuugucgguuggcuaaucuuuaauacauuguuuuuuaaauugugaucauucaaaaguauauuuuauuacuagacuuuuauccaucuccacuuugaagaauaucuuucacaucauugucuucuugcguguugggaauauaaaauuggacaaagacuggauugcccaugcaguuugagaagugguuagaucagaaagguguuaacaucaccacagaauuaaucuaugcaugaguucaugacugaauggacguuaggaguuagagccuagcuggaaacgggucacuggagugugccuuucccccagcccuuguucugcagucuuguuucccagcagccaugggcugaccccuaugaaaccaugagccaagagaaagcucuggugguauuuaacucacauacauugucauacugacagaaauugaccauuauagcuaccuuaccuugagucuguauuuugaaaagagaagcaagcuucacuauugaccugaucuccacccagagugaguucugcccccacugauuuccuuucaucugcccacagaucugccgacuugaacgccauuuaucuacccagcaauaccaaggaacccucuuugcuaaucagccgaagauguucauagcgccagccagcagcccucccagagccaaacugugugaacugguacuccugugugguggccaagucagcccagccccucagcuggccagccucaucauuggucccuacaagggcaagaagaaagcaaggauccaguaccugucagagaaaugggucuuagguaggaauccagaugguggaauauaagcaggagggauagggaagggucuugcugaucacauggcuaucaggagcucaaagagaauacugccuugagguucugggaguaaggacaggacuugggaaaagacagguggugcccauguggccuggaccugagauuaauagcugagccuccgggcaucuucuuuaacagucauagacacacuugcccuuacugccagcugaagaaccauucacgaggcgaggcaauaagagcgggccuuaucucacucuuagcguguuaagguuaccucagccucaagucgcaagcacaggaucaccaggguacacuagcuggcuuggguucugcaggcaccuguaucaugugcuacccaagagucccugggaagaagagauacuaaacuagacacccaggcauaggaagcuauucacaugcaugauggugcuagguggccuucaccaguuauuccacuuggaggacuacaggacucucaagaagggccauguagccagggguuggcauucuccugccaacuccuccuccucugccuccccuccuuccucccuucuucuccucucuguuccuucgcuccuuuaaugcugggcucaaagccccacaauagacucaucccagacaggaugaacucugggcuuagcucugaggauaaaguuaaaucuucaucccugagauuuugacaguuguauugguguggugggauuaaguccugccgaccauuuucucaccauuauggaaggccaagggcaagacuggaucaggcagcucuccuguggcuucccccuggaccugcaggccacaucccuucccuguguggcuuccuuuuuugaguccacacuuccuccuuaagugaggacugguucaaccccaccuggguccaaucuccaaauacauccacgugcucaggugcuggagauugggaugagaugucggaauucugggcggacucggcuccagccuaacagcggauuacccuauuugcagauccugaccugguccuucagugccaucccccccccccaccgccaccccccccccccgcccugccccccugucgugugcuucuccuuucugccuuuccucuccguuaccccguccuccucccuccccuccccuccccuccccuccccuccccgugugcuccucuccuccaucccuccuuagacuucucugccugucccaguuuuccaguucuucucuauccuguuuuccccugaggcugaggucccugcugggcccuuuagaacugcccccuccccauauguauccaucucucuuccucuuucucucccucucucccucucucccuucuagcuuccccuuccuacuagguuucuuauucagccccccuuccccaccucccccucaucucucgaccaucaucucgaguccuggcuucucucacucuccuuucuccuugaauagauaaauaaauaaccuuguucuccaaaguuauauucacacaaaaacucauguguuuuuugaguagcuuuuaaaugauugaugauugucccuguacauuuucgaauaaggcaaucaaaaguacguuuuacucucugcuacagagcaguuugucuuugcuuagaaagcauuuaaaaaaagaaaaaacaucuacccuuuaguucccgucccaaagccaagccucuguuuauucuccugaaugccaagaauagaaccuucggacaucccauguucuaaagccggguucuuguuuggcuucuuggaaaagugaaucaaauugaccgccacugcagaccagaacugagcuuugaaaacacgccuguguaugacugguaucagcaguccaaaacaacaccuaauaguucccaaguucgggaauuguggcugcugaggguggggguugugggggcggccugagccugagguccugcuauuuccaggcuggguggcugacagccuuccuguugccccagcguccugugcagucccugucucagccaggcugaguucuuccgguuguuuuguugguuggcuccggcugggauuuuaggggaugacugccuaccugcugugucuaccccaaggcccccugcaacauucucugcaugccagggcuggcucagagaccccaguuugugcuucuuuccucccccuaauugacguccgguugcugaccugucauugauuacaccagcugcuaugcccuuggcaguauccgggcauugugugcacucgaggccugccuguguaagaugaguccccauggcuucuggguacccccagaauacaccaauucuuccagccugaaccauucaucuaucuuucaaacaccaguuaacucaguuaauggucucucugaacugaauucuagcccugguauugccuccacaucuguccauggagcacagaucaacacgcacagcguaguccuauguuugguguucccuccagacucugcacuggcuugaucuguuccuaucccucuuguacacuggccaagggagacacaagaacaugugacaugguauaugcugugcuuggccuucccaggauuucugcauuuaugcaucucuucaugcauaaacuaucaccccggugccaugacaaagugacugugucuccuuuaaacauucuuauuccccagacuucuauuauuauaaacauuucucuauaaacauguuauuuucaggcuggugagugaggcuaaguaauggaauguuugccuaccaaugcaggauccuagaucauucuacagagggaaaggaggagggaaaagaaagaaaggagaugccgcaugcucagaacauacuaagagaagcuucggguagugcacuuaucuaagcauguaugaagaaaccucaaaccuauucuaaaaaaaugaaugaauuuuuuuaaaaaauagaaaaaaauacuaagauuaacaaaaacuuuuaaggcauggauuugugaggggaauuauuuuguaauaagcuaugaaaggcaauauucaguauuuaucaauuaaauuuacuccaacuggaauaggcaguaugaguuugggccagggagagucuuaagagcaguuuggauuaaauauuuaaaaauguuaaaagcaucuuuuuaaauccacuuucaaguuugcaaguugacauccaaggcugaguggugcauuugguugguccauagcuuaaugucuagucuuacagccaaugaguuuccugaaaggcugcugagaagcaccucagagaaacugaacgauccuuaggaggauuucucagcgccuccagucugaguuagcaccgugcauccugccuuccuggcuauugugugcugcucacauaggacaugaguggguacagaaugucacccuguggaauucaacagaaggcauuuaauccuugucuuacucaugugccccacauggugcaagccgccacacugccuuccuuacaaggagucccuguuccccauucacucccuagagcccauuuucccugaaacuucccuguacucaggccagcacuguccaugaaucauucaagcagaaggagaaauggggauuuuugagcaagaacacccuugugggcacuugaauaugcacaaaaaucaacaagaaaacaagcaucaaauucccaguagcaacgaucagguacuacuuguccuaaugucaguaauguggauguuacuuaagacugucuuccaaucgucagauucuccucgucacucccaagaaaggguaguucccaugucacauucucaaaggucacagguucugagaacuuugccuggucggaauugacaggccgagcugucaagccguguggcugggugcugugcucauucuuggucacgccggucccuccccuugauguuaucaaauaauauggguuuggcccuucucgugagacuaguccagucucagccuccccuuaauugucugggauacauucaagagauaagaccuacauuuaugcuauuguggggaaaacauuuauacuauuguggggagauagugaaauauccuccacagagcugccagaaaaaguuuagccuugacaugacuucugcauaccuuaaaaaaagcauuuuacuugacuauuucccaugucagaacuuucaggacaaagggucccugauagcuugugggccuucccaugcuggccuauucaccagcuauguucauuaacuggcuuuccacggaacaaaggcuacucuggagaccguggaccuuggggcuucauaauuauauggacacaugaggcuuagucaagcucaccuuguuccuuauuuccauugcuuagauaagaacuagucaauuggcugcugaaguuguaguuuagcuucgguuagggaaauagaugggaagaaugaacuugagaaauaucccuaagcucucccaacaguccagguaauuguccuugaauuuuccuggccgggcagugguggcgcacgccuuuaaucccagcacuugcgcagcagaggcagguggauuucuggguucgaggccagccuggucuacaaagugaguuccaggacagcuagggcuacacagagaaacccugucucaaaaaaaccaggcuacccuuggucaacucaagucaguuccuucagacucccucagcacaaaaugccaccucaaaacaaccaaaaaaaaaaagucaucugugacucuagcucagggcagaaaugaggagagcucaacaaugguuuguauccauuagaagaaaugugugugcugguuuggguuugggaagucucagcauuuuugugccugguacgugugaugugacgugcgcucuauaaaacuugcugguaagauugauuagagguucaccaagcccugcagcagccccacuccuaagcaaggcccccauguaacagcugccccauggcacccaaaaggaaguuaacauaaaaggaacuucaaagugugaccuccuaauggcaugguacugaucacuuagccugucugugcucacuggcuugguuaauugaugcucuugcuuaugacuggaauguaguucuuaugugacuuccaaguaccugaggcuuuggcuccuuuucuguugcuguugccugcuagacguuaagguuaaacacccuagacccucaagugaugaagguucaaguguuugugguaaaguccgcagggaacuuggaaugugacuguauuuggagauaagaccuugaaagagggcaaaagguuaaguacucauaaaaguaggauguuaauccaacuggaugguuucucuucucagaaaaggaagugggaugucauacuguuagugcaauuuucuuucaauugaaagauugcaaacugguagauuucaaauugcguagugcagaguccaguguucugcaaacauggcugagacugaggugccccacccggagcaaaugcaguaggccuccccuaucuucgaagcagagcaacgguaguuggauggaauuaugcuauuuuaauuuucagucaguuuuucuuaaacaacgaugcuugaagauuagugacagcaagauaaucuugcagcacaaaaaaggggagaaaaccguagugacgucaucaguguucaugguccaaagcugagaagaacacaaggguggacgauacugaagcuuggcugucuaaauagugaaaaaugcaggcaggacugagaaagggaggcaaagcaacaacugcacacaguaggaaugcacaauagggaugucugagagacaacugcacacaguagggaugcacaguagagaugucugaaaaucaaggcaguaggaugagcagcuuuguguugguaaaucuguagaugagaagccaaaacugaaugagguuacagaaaacaugaacaugagcggucaugaaaagugaaaaggagccaggaaagcaucucucacugcaggagugcggggccacgcccaccaucagagcccugguccuggacccaaggaccccaucugucacaaaagugaaagaaacuaagaaaggccaaucugacccucgugggauauccacacagccuuuagaggauucugcaagagggauccucacaccaucucacagaccauggagauuggacaggaaaggagugggcacaccaucaacccugaagggaggcagcagaagucaaagcaggcggaugagcgccugucacagcagacuucuaugaagaaugcagaaaacuccaugacucaaaagcuaauaguaagaaauggaacaaagaauauaaaaagaacuuccagaaaacauacaaauguacaaucagcccaugaaaaagcacucaauaacacuaaccacuggagaaaugugaaucagaacccuacacccauuaugauggcaagauccccuccucccccaaaaaaguguugaagaaaaugugagcaauuugagcccuugucugcugcuaagggaaauauaagcauuguaaccacuaaggaaaacauuguugagauacgagugacccagcagcuccacuacugcgcauauuuacccugccccaaaugugaaagacaagugugagugagugugugugugugugugucuguaauuacagcagcaucauugacagcggugaacgguggaagcaaccugaguaucagucaacagaugacagcaaagcaaauacugcaugcccacacgguguacugucuccugacugcaaagggggauccugguacccucuccacacaauggagacaucgugcccagugcaauaagccaggcaugcgauauccccaggacagacaaagucacagggauggaacaugugcccaggguuuccugaagcaacugugaggagcacaagagugggaagucacuguucagagaaggauacagaaauuugguuugggguccugagaaagugcuugaaauucauaggugcugguaguuucacagcacugugaacauacuuuuauugaaacaugcaguugaaauagcuaaaaugguaaauuuauacuuuguauaucuuguaaaaauggcaucuccucuauauaauuuuaguacuaggauuugccaaaaauagcagauuauugcaggacgauacaaagaggggaguuauacaccccauuuuucaaggcuucugaucuuaaucuaaucacucauuuugucagcauggauauugaaagucuaaagugaagcauuagugaaucaaauuuaguaguuugcuaaaaguaaagugugcauaaccacguaucaggcuacgaaucugagaauagugagugacaggauuggucacucugucuguuacuuuuuccagugguguuaaagaccaugaaagaugcuuccacccauggcaaacaugccucgagaaccaggaagaccuucgauuguuuuguuuuuuuuuauuuuauguauauuaguacacuguagcuguacagaugguugugagccuucaugugguuguuaggaauugaauuuuuaggaccuaugcucacuccaguuggccccacucauuccagucaaucccacucccugcucgauccagcccaaagauuuauuuauuauuaaacauaaaguacaauguagcugucuucagaugcaccaggagggggcgucagaucucauuacagugguugugagccaccaugugguugcugggauuugaacucaggaccuucggaagagcagucagugcucuuacccgcuaagccaucucuccagcccgcaggaauaccuucuuaaccugccuguguuaugugcuaagaaguagcuaugguaaauuacuuaauagugaaaaucucaguguaagcuucaagucaaguacaaaaagcacaacgcugcuccccuuuucaacaguauuccggagcagccagucaggggacagaauggggagcagggguagccuuaaaggcugagagaaaccauccuucccugguguaauugucuauacagacacauccaguaggaacaaaaagaaugccacaacuaaguccgcugaguugaaugucccagaauccaccacagagauggauaucagacccugugauuuuauaauagagaaaauaguagguggugcuggaauggccuugugcuaagucacuuuauuuccauguccgggacagcaaagaguuccaugagugacaguccagggcaaacugucgugcccauggcuaacuccucagugcacccucagagaggugccauguuaagggugacugacccugggcaguaccagagcugaaaggaauguuagaagcugccuuagaccgagcuuuuuccacaagaauacuagauuaguuaccugucucuuugcucagacaaaauauacaguggcggcuuaagaaagggagggagggaggggaugagggaggaaggaaggguggguuauucuggcucacaguuuagaauucggucugucauggugggaagucacagaggcaggagcaugaggcgacugcucacauuucaucccuucaggagcagagggcugaggucuuguucucagcucccuugcuccuuucuguucagucuaggccuugaacccaaggaauggugccuuucacacucagagugacucuuccuacuucaguuaacccacacuacaaacuuccucacagauacaucaagaauuugucaagagguugucuccuagaugguuaucaaccugucaaguugucagucaguguuagcuaacagacgugcacacacauacacaagacauugagcuuaauuuaucguacaggaaaaagauagcuuauuuuguacugcucaugugcuaagcaucuugcauauucucggaugcuacauguauaauauuuaacaagaaagaagacugaaagcaggucuaagcaacaguugugauagauaguaugaagaagauggagugcaggaaugaaugggaugagggagguccuugcugagaguggcuuuggagccacagacugaguaagaaagaggagcuggacagaccugugcccuggccugguagagcaaggcuucagucaggagaagcagucagcucaggauggccuaaaggaagaauagaggauuaagggaggggagugaggccaaggaaagcugcugccuagaaguauggguguuaugaagugcaaguaggaaagagcucuguaggggagaggggcugcaauccacauguuaagugaugcuggcuccuagguacuuggcugaccaccaagggaguugagggaugcuaggaguuuacgguggaaucauguggugucugauuuuaauugacauuucaguagcucaugcugcuggauacaggagaaaugaagaauggugguuacccccuggacuugguuucugagcaucuaagacaaccaugaguagagucuuaaaaagacuaggggagagguacugaaagagcaaaguucggcucagccuguggaaggaagccugugggaugaccagagacagcgggagagaccagcuccaucagcugcagauagaacuaaggucaaccugugaaaguuauccaggggcagugcuggguucaucacuggagacugcguugggauugugcuggcuagcuuucaugucaaccugacacaagcuagagucaucuaaggugaggaauccccauucacaaaaugccuucauaagauggggcgguagccaagcccacugggcauuuucuuaauuagugauugacagagaaagcacaggccauugugggcagugccagccugggcugguggugcugggcacuagaagaaagcagcugagaaagccaggaaaagcaagccaauaagcagcaucuuuccauggcugcuucaucugcuccugcuucuagguuccggucauauuugaguuccuauccuaacuucauuuauuaauggacagugauguggaaauguaagccaaauaaauccuuuccuucucauggugcuuuaguggugguauuucaucaccaagaugagauauccauaaccggagccucuguugcugagggcugaaguucuugccaucaaucucccccagaggcugggcguggugccgcacgccuuuaaucccagcacucaggaggcagaggcaggcggacuucugaguucaaggccagccuggucuacagagugaguuccaggacagccagggcuacacagagaaacccugucucaaacccccccuccccaccaaaaaaaaauauccuccagaggcugguugauacucaucccacagugaaguauuggagaugccugagugagucggugaacguggucacugaacuuucuucuggccuuuugacgagcaaagagaaggccuaguccgcagucugcaguccgcagugcucuugauuuggcacagugucaucugcuacuagcuaccaaguuuuaguuaaaccuagugauuuuuccuccacaccauaaaacauuaauguuagcagcauguuggucccccguacaccaaccauaagaccacacagaagugagguuagaaaacuguggcucacccuagauucaugccaaguccuauuaaagagcauggcagggcaggggguuagaguuuuuguuuuuguucuaagaaagaaagaacuaaggagggcaggaaagagacagugggaggggggaaaggcuuuggccucgauuucaagggcaucuccagcaucuuuccugcuugaaauucuuagcaguguagauggaaucccagcagucaagaagaggagccagggggaucaauaguuuaugugcacccugggcuacaugaaagccuaucucaaaaaggugaauaauaauagcguucauaacgguagcuacuuauucuuauugucuggggcaguacucugucugcaguuuaaucucugugugacaaaacuggggaaagagaucgugucauuugucugccguguggguucugcugaugugcagugccuccuuucacucucuucuugcauacgggcucauuucccugcagcgucguguuuguucugggcaaaccucagugcuguaauuccaacaauucagucauuuuuaucuccugcuuucugugauggagucucuauguuaauguucuuuuaugguaaaacuuggaauuuggggauuauauugaauuaucagauuaaguagaaaaaggcuuucuuucaguggguuguuuguuuuguuuuguuuucugacucuauaaaaugauccggucagaaauccaugugaaaaacuggggucuaaagagcucuuacaaccugggugaaaauacggcugaaugacuuuauagaccagguacagagagcagcagauugucaucugugcaucaaaacccagguacagugaaacaaagcgucaacccggugugaacacauaaagaagacaauagcuuuuacauggcaaaagcucauacaagacaaagggcaaaagacauagcauccugcagcgcgcauugcagggaagguaugaagcauggggccuacugcaacauugcagacagcccauccugacaagaguugucuugauauacagugcuguggguguaguuagugugcuucccucuucugacgucccccagggaaccccucuccagcucacacucuuauauggaagcauaucuauacaggaaggcagcagugacauucuggaacaguuccuuaagccaaaacuaagaugagcuuuucuauuucuucuacugcccauuuauuuucuauuuuuuauuucuagaaugaaccagucuuucuccucccuuguuccacucagccaccauagagguccaucuuccaauaggcuucccucuucaaggcccuucagauauuauugucuaacugauuauauagcugucucaugggagauggccuguaaucauuguaauuaagcuugucaccaccaggcagccguguuccuuuucuguuuuuguaguaagacaguuauguguaguaagcaucuuaguauugacaaaugauaguguauuagucacaauuuuuguucuugugacaaaauuccugagaaaaaugacacaagaggaaggauauguuguggcccaaugcaugguuggcugguucuacugucuugggggcauaggcagacagaaccucaagauugggggguuguacacagcagagcuuauacagcuuauagcagcuaugaaacuuagggagugagaagaaagagccagggcaggacccaaacaaaggacucagccacccacuucugcuuggcuuuaccccuaaaguuuccagcacuucccaaaguagccaugccagcuggggacugagcuuucaacauaagucuguggaacauuacacaucccacuacucugaccagcugacuagcucaccagcuuucccugggaccagauaguuucauaaagcaaugaagcuucaaacugcaagacucuagcauucccccauuccaaccucauccauugagccacaaacuggguuuuaggaacugugccuaccuuuguauucaucauggaaucccuagcggguagacagccuggcacagucuagauaucauaauuaauauaauuaaaauuaaauauuuauaaucugccuucuaacaguggguauugaaguagcucacugagauuagagcucagguaucguuaaagacagcugucccagcuccguccaacagaauaucugcccugguaggaauguccucacugugauacaaccuaauaggacaagggacugucaacuggauuaaucaggggccggugugacugguauuacuuuguuuuacuuuauuucauuuuauuuuuaaaaucgagaguacuauaagaacaacugagacuauggagagcucugaaacauuuaagauguuuaaacuaucaucuugugaagcauacaauaaaggaucauaacagagcagugguggugcacaccuuuaaucccagcacuugggaggagaggcagguauccacaggggagucaguagaggcagagugguagacauucgcaaggucgaauugaggucagcccggucuacaaagugauuuccagggcuauacugacaagggagggucgggggugggggaaguggauuuccuguguugcaacuagcuaucuuaacugucaagcugauuuuucuuucucuagauuccaucacccaacacaagaucugugacuuuaacaacuaccaacugcuacagugagacaucuacaaugaggcugcuauccucaacacucaagaagaacaacucuggagaaaaggaaccagcagacaccuuagggcuugaagucacaugucacuuugugugcuaugguuuuuaucuucagaggguauguggugugugugugugugugugugugugugugugugugugugugugugugugugugucuaggugucuagagauuaaauccaaggcuugcuaaguaagcacuguacuguggaacuacaucuccagcuuuuauccuuaaaacucuuuauguaacuuauucaugacucauuguauuucagagaagucuugaccagcaccaguuggguacuuuauacaauacuaauaaugaucaugauggaaaggucacagaaccuuuguccuugagauacuuguucccaauuauagaauggaaguugauuuaaauugcuguaguccuaaacaaucaaauagcucccuaacucuucugacuuagacgcugagaucuuuauuagcauguugugucuagauaggaaggacaaucaugcauuauuaagauugcaauuaugucccuugagaugccccucagaacaacuaaggaagacagguaugaacguuuuauucaccgaccuugcgaaugucuaccacucugccucuacugacuccccugagguucccuaaggaaagucagcuucugggguagaguucugucaaagguguccaacccaugacccauguaucaaacuuguuuaaggguaccuagaauguagcucauauaaaauuauaaacauauuuaaaaguauuaagagauuuguguguacauauauuucccccaaccccagcgggguuguaacucaauugcacaauucuuccgggugaacucuagaugaccacguuguauuacacugugaaaaggcuggacgugccaucaucaggucaaucacucuucagugugucgacacgggagacuggccuggggcuugcagaccuccucuuguugguguccccaguguugggcuguagucuagugccaccacaugucaugcugcuccgucaccuaacagacacugagucccagugagcuuaaaagcagugcucagcucacuguaguuuucuguguuacgacucaugucagcugcuguuuccaucucaggaagccucaacaccacuuccaaaaccuugucaucuccgagauaagcaauuaaagcguacaguuugugacucuggcauuggccuuguucccuguacaauuaaugcucugaugguucauucaugucaugugugucagcacguaauuucuuuuuguugccaaacacuauccuauggcauggaugcucuacagacuugcuccucgccccaugagcagagugcagguguaaagcccagugggaaagcaguugaugaugucacguugcguugggugauaguugaugaugucauguuguucugggugaugguugaugaugucauguguugcuggaugauaguugaugaugucacguugugcugggugaugauaguugaugaugucagguugugcuuggugaucaguaguccaggcuccguggaagaagaggaucagaugagggugugagagaccccacucaucacccuccucaucuucuguaaucugaguaauucuguuuccccucacaaauccauagcuugaagccaucacuugaagccagaauaaugguguuuaaaaagugggguuugggagaaauaaaagagaugcccagcaa

SEQ ID NO: 12413 - RNA, 1849 nt, Mus musculus
uuucgauuagggacagcggcugggcgagagggcggagcgguugggacgcgagagaggaggggacuuggugugagaggcucaguggggacaguuccgcgcgagagacaaagagcgcccagagagcgcagcgagcaucgcugcuacccagcccggcaaccucgcagauucgaggacagggugcgcagcggagcagccacagcugcuagggacccaagaggcuacgcaggaugcggacgccgguggugaugacgcugggcauggugcucacgcccugcggguugcugcuuaaucuugucaguacacuggccccgggcuggcggcuggugaagggcuuucuggaccagccaguggacguggugcuguaccaggggcugugggacauaugucgcgagcagagcagucgcgaacgcgagugcggccagcccgacgaguggaacuacuuccagacccagccugugcagguggcccggggacucaugaucacgucacuggccacuaccgcccuagggcugcugcuggcuucccucggugugcgcuguuggcaagaugagccccacuacgggcuagcgggccucucuggcgugguguuuuucgucgcuggccucuucagccucaucccggucuccugguauaaccacuucuugucagaucccgacguccuggccgccccgagcucgccggucacggugcaggucagcuacagccuggugcugggcuaccuaggcagcugccugcugcuucugggcggcuucucucuggcgcucagcuuugcgcccuggugugaagagcguugucgccgcugucgcaaggcgcccccagcaggcccgcgccgcagcagcaucagcaccgucuacguggacuggccggaaccagcgcucacaccugccaucaaguacuacagcgacggacagcaucggccuccucccaccgcagagcacagggacaccagcaagcucaagguuggauucccgaugccacgaccgccacccaaguccuacaccaacccgauggaugugcuugagggagaagaaaagaagacagccaccucccaaggugguuccuccucucgcagcacucggcccugccaaaauucgcugcccugugacuccgaccuguagacaggguucaccugagcucugccuggagucugagggugacuugaacuucugccaguacaucugcaacuagaacccuggucgccuuccucuaacuggagggcaagccuuccuuuucuagggccaaacuccucuccaaauacuagguuggguucauuuaucuuuuaaggaguuuuacuuuucucuccagagggaccaggucuucuuaugcagugacaagagugcguaguguuuucuuugcauacuguucaucgcaguagcaacaaaauugcaaucagccaacaggcuuuaaaacgucccugaacguacaguauucuaaguuaccgugagccuucacaaacaucauucucgagguuuuuugcuuuucucccugcuucagucuccagagaacauaaauggccaaaaauguuaagucuggcuauauuugaagguuaugacauaaagccagcagcuuuaauggcuuuuaugaagugaagugacuuguuuaacuccuauuuauauuucucugugcauauauaguauuuaucuuuucuaaucacuuguuucuguguaggagguugagcuugucuuccaaaagccaaggcgaugcuacacuguccuguucccgagauaccucgcccugaacagagauauauuuuguacaaaaugaacuguuaaguugccuuuggcuaacauccauauguauauaucuuauuuauaaauaaaaauuguaaaugucaguuucgguaucccua

SEQ ID NO: 12414 - RNA, 46131 nt, Mus musculus
guucuuuagcaaaugaucaauuuauuaggugucuacaaguacaaaacacugacagcugcuguagagaaguagaaagaugugcaggagaugagccugcccuugaagaacucacaaucuagacccaagaaucaucacggggacaaaucguggccacaguacaagauguuaacaccaguucuuggaaaguuccgugcucugaauucucuccucuggccagacguagguaaucucuucaacaggaaagucaaaagugggaaagagaccucuugcggacucaucagugaccuuuccuuugcuucuaagcaucguuccguugcuguugcucuguucuuggaaccucugggcauccuuucugaccuuggucuggggagacucuccagacuuccugaaccuucaccaggccuuccuguuggugggugaguggcucaguugcagcuuggccuuggaaugauucgucauugucgucugacuucucuuuaagcugaugcaucuuuggucuuugcuuggcacgggggcccuaagcuuugcaaucccugcuucuaagggcgaggaaggugcaagucagagagcaggccagacucuucccuuagacauuuaauagugcacuuaccgaauauacucuguacagauauagggcaaauuauaaaccucuuccuuuauuuauucuuuuuuuuucuuuuguucucuaaaacuguauucacuuaaaguguauuuacaauguggggaggggaaccuugagguacaaaacccgaaagaauaucugagguauaaauacaaguauaucuuaaauaauaaucuuuaucaugcuuuaucuaugucugaaagcacaguagacagacauguguacauguuucucaauagaacgguauauacagcauacaaucuuacagauccggaagccaucaaaguugaauauacacacacacauaucuucacaaagcaacacugauaauuugaaauacucagacuuuaaaacucuacucugaccccuccccacccccccuauucuucaaagaaccuuugaaauaauacugacaagguaacaauguuauaacaaaauaaaaguccuucuucagcucucauucauacggugcucacuguuuugauccauacaaaauauauuuacuaauacugucucgagucgauccuuaccauuacaguaaaaccuguauaaagaccacccuuccaagacccugcgcuguuugcuuuucacugagauuacuaucccacauuaccacuaaaauacaguucaagggcauaaugagagagagagagagagggagagagagagagagagagagagagagagagagagagagagagagaagaaacacaggaaaauaacaaaaaaauaauuauuuguggaugaggacaaaccccauuaaaauacacacauagccgucaggaacacugacagcaccacccacaauuaacagccucugguguuugguuggguuaaaccuacuggggacauaguucccugggcuccuuuguguaucuuggaguucaugucacaaacaacaauauacuaugaauuguaacagguaaacugagcugagcccuuuaucccaacuaucagaccuagauaacuugggcuauagagugaggcaguuguucaagaccagccugggcaacauggggagacccugucucagaauaaagagugaaaacuguagagcacuugcccagcauauaaaaggcucuggguucaacacccaguacuggaaaucagaaagcguugauacuuugcuuauggguggggugugucagcauucagcuuuuccaucucacuuaaauaaaagccuuuggagccagucaaagggaagcuuggugguuagccuugaacuagucuuauggcuaaauuccuagucacggggaagcuacaguuuaugggaaagcaaagguuugcagaaaagaaaaaaaaaaugcuuaauaacccuggagggggcgggugaagaaggaagcuggauuccccaucuggguggcucccuggguagucagcuauuccagguugagcuaaaccugguagaucagcauccuuugcggaacaucucagugugccagacacugcaucgcaucccuucauccgugccacucagccagcaacacacacauucacacuccccugugcaaacccuucucugcucaucucagugagaaaaccuguccgagaguaccaacuauuccaguggauacaucggucccucaguacaccgcaaacaaaggaauagguacacauacgcugacgucacaaaagaacgacaccucuucguuaucuuccauuacgcgccgaaaaaguucuugcuucucagaagcaaucugaacaauacagguaccccccacccaccccugcccccaaguguuauauauuccagucaaggucuaugauauagaccuaagacagacaggaagcagcuuuaugaacgugucaaaucucuacagucaaucagacccagaugaacucuucuuccaaggacuggcaaggcucuagcaacaaccgcccggguugcagucacgggugcuucauucgcgucggucaucaccuagaucucguguccuugcuuucaguguucugauuacugaaggagucucggaucuuuaccacuucggcugcacacaaauguccaaaagauuuugaguaccacuccggcauguggccccugucacacagaaagaaaagcuggugaguuauuuaaauuagaaacaacgaaggcauaugaggaucaugcucaggaccucaugauugagagaaaaagucuucacuacugugcugugccaagggugccuacugccauuccugucucucuuugacacaguaucucuauauagcccaggcuggccuugaacucacugugacuggucugccucagccucucacgugcuguauaccuauugucaauccuccaugaggaacacgugaaaguaaggauugcuuucugucagcauucccauuacacauuuaggcccagaagguuuccagggaacaccauuuaaagcugcacacccgggauacuggauaacacucagcgacccugcuuagaaacagcuucagcaugcaucauagauacagauggcauggguaacugaaauuuacaaagggggaguguuuuuguuuuuguuuuuaaugaagugagcagucacuaguugaucuuggacauuuuuauaucugaagaaucagguucauuuaccgcacaaagcaaagcaugcacacuguucaaacaccuuccauuauaaaguaggcagcaucuacuuguugguucaauauaaaauauacuacuuccuguggcuuuaaauuugugaugaaucuaccaaauucgcagcgcuuuaguagcauuauuuccuagacuggaagcaguacccaaaaggacagcaaacaccaagguuuugcuucguauguauuaucauuuauuaggucuccaaaacacagugacaggcucauguccccuuucuuggaauuauauggaaagucugcaccuccugcaucaccauccccacauccaaaggucgggaucagaauguaccuuaaaucagcucugcacauguagguaagcuuggauuuuccugacccgcaggguucaaucaaauaucuggacaggagcacauuaacccucacccccgccacgggggcccggucgugauccacagaggugaguaagagagcacaggccccccuggguaaguuaguccuccagguccugcggagacaaaaccaaaggggaaaugagauuucucagaagccagcuugaaaauggucccucuguccugggauccucccaaccccugcgcauggacucuguguggacaaccugcguggggugugugcuggcuggguuugugugucaacuugacucaagcuggagcuauuacagagaaaggagccucccuugaggaaaugccuccaugagauccagcucugaggcauuuuuucaaucaguaaucaauaggagagggcucagcccacuguggguggugccaucccugggcuggugguccuguaagcagcaucccuccauagccucugcaucagcuccugccuccagguuucuuaaguuccugccuugauuuccuuuggugaugaacagcaguguagaaguguaagcugaauaaacccuuuccucccuaauuuguuucuuggucaugauguuugugcaggaauagaaacccugacuaagagaggguggaaaugcucagucacacagucucugaacguuuuguuuguuuguuuguuuguuuuaauguuuuuugagacaggguuccucuguauagcccuggcuguccuggaauucacuuuguagaccaggcuggccucgaacucagaaaucugccugcuuuugccucccaagugcucggauuaaaggugugagccaccaccgcccggcucuuuuuuuuuuuuuuuuaauuaaaacaaaacaaaacaaaacaaaaaaacccacuuuuacauuucaugaaugucucaggucauggacaucaaacaagcagugaacaguucuggaagaguuaugugacauuuccucaaagcuuucugaaacugcuccuucaauagccuucagacuaucgaauucagacuugggagugacguaacaaauaaaucagccuuaaucacagaucacuuggcacucaaugcuauuucccuauccacuuguuagcuguuucuagccagaauaucuauauucgauguggcagaaaucuagcaccaugguggugcacagucacuugaaaaggcguucccuuucugagcucagucacuacccagugaagcacccuguugggacaaacaugacugugcuuugaaaucgcucaucacuguucccgacaucuaccucugguuuugaaggcuguaaucauauuguacguuugaguggcacaugggcucaguccugaugucuagucauccaugucacagucaaaucaauuugggacucaccucaauacgacguagucccgcgcaggguggggcgccaugcuguuuuggacguauugguagauuucagucuggcuguccaggauuucaaucaccuuggaguccagcagguccacaucccagagguguugcuccuucagaaggcgcuuuaagaucuccucgggugcagcggggacuucgauaguugaccuccaaagccuuaacggggguccuucgcugaccugaaaggaagauguggauuguuuguuuguuuggagaugggauuucucuguguagccauggucauucuggaacuuacucaguagaccaggguguccuugaguucuagagauccaccugccucugccucccaaguugguggcaugcaccaccaaugccaggcaagaugugguuugcuuuuuuuuuuuuuuguaaugcuaaagauauauacuuugagucugaaagcaaauuuugaguaggagacauggccccucuguucacagacugauuagucaaucuaugaaguugauuagcuauggguucuaaauacauucaagagcagucuacaaguaccaauaaaauaguguccaauuccuguggcuuguaugaggaugacugugacaaacucauuuauuucaucccuaaguccguauggccauuugaccacuccauuuucaaggugguagagacaguguugacaaaccucuugcugagcuacaaagaaugcuccaaacaauggcucagaacacaugggaguguccaacuauuuucuuuacauuauauaggaaaaagacaucucaacauguaccaagaugcccuuuaaaaccuuauaacacuagugaaccuucuagguaaggacagggcagugguucucaacuuuucuaacgcugugacucuuuaauaaaguucucguguuguggugacccccaaccauaaguuuauuuuuuuuuuccuugcuacucccuaaguaauuuugcuagcauaagucauucugcuacuguuaugaucguaauguaaauaucugauaugcaaccccgaaggggucacagcccgaggauugaggaccacuguucuaagaugauucgguggaaggaaggaccuucuucccaagcagacugagcugucgcaagggucaguguuugucccucuguggccaguguccauuuccccaggggaucuuaaucaccuggcugcccaacgcagcgacaguugucaguaauagcuagagauucccacagagaguacaacugggcagucucaggucugaugacucagucauagccacaggaacggaccagggagaagacugaccuucuuauaggacagcucagccuguucggaggugggguagcugacccagccuuugaacuucucuuugaccuccuuaaacaggccauccacacaguccuggaggaagugucuguagucagcaggcuggucacuauucaggugucccaaggccuccaggguaaggggcuucagcucuuguucaguguaggaguuacggcaccggcucauuuccucagggaccugggagaaacacacaaggauagauggguccgucagcaccucagcagaagucgaagggcagaaucaacggccugacucaagcuggcagucugcucccucaagacagugaaggauuuagguauucacaacagggcugacauggagcaaagcaggguucucagacacaauguuaauuccagauaaucuguugcuuuugccuuuuuuguuaaaaaaaacaaaacaaccuccccaccccaacaaaaacaggguuucucuuaugugguccuggcuguccuggagcuagcucuauagacagacugucuucaaauucuguuuuugcuuuuuaaguaaaagguagacaguuucaucaaaaauuaacugcaaaggguguauagacauacauuuauuuaaauacauauaaaaaugccugucucuguguguauguguauggaugugagagagagagagagagagagagagagagagagagagagaggagucugucugauugucuguaauucuuuagccuauguacauaaucuccaauuaugggaaagaucuuuugugugugggaacaaguaucaagucgaugaccuucgcccacccguccacauuaucccgagcccagcagccaagccuugcugggauuguuaccuggaagagcuucuugcacucagcaaucaugugggccagcccuugagucgccgcuagguuuucauucaggucuuucuggucugguuugcccaaacucuguuuucuuugcauuacccugagaaaaaaaacagaaaggguuuugauaaugagcaugugacguaguccagagagccuuucacuuuuguucagcacagcuucucaacaguuucauucaaaauacaacgcgaaauacuaaacagacacauucuaguuaaauauggagacuguguagagacaucuuaguaagcaguucacaagagugcuuacgugcgagugcuuacgugcugaggcaccuucuaaagggacugaugcgggcgccguuuggacuagggauggaugguuauuggcuuuguuacuggcuaaguaaacaggaucccuuaccguaggcgagggauaaaccuauuguucccuggagguuuggucuuauucuuaucuggccucucuucuaaucaucuccuguaguuuuccaucccauuaaagucggaaugucccaacagcuuuuaacacuaguuaaaaggcuauuugaguacugugugguuuccaggugcaauggcggcaauguaucaagcugagaaacacuuuucagguuccuauggcaagacacgggaugcgcuggguccacagacaaccuuuccucccacaguggaggggaugucuucucaggagccauuugccuaagaacugcaaaucagaucugcuacacguccucuaagcuucacuuuauuuuugagagagagagagagagagagagagagagaggagagaacaguauguccaucuccugugacuguuaugaucugagaaggugaauggaaaggaaacagcccuauacuagguauagaguaaguccuggugaguaucagcuguugugagcacucagguucuuccaguuuuccuaaagcuacuccugccuucuagacagaaauguuugccaacaauuggcuuaggccauauguuaaguaggaacaacucaggcucagaaccucgguccuuuguagcuuugcuuucaacuucaggaacagaccaggaaggugucuuuccugaucccacagaggcuaaggcucuggggaucagccacccgcucaguuucaggucaguaggucugcaaggcuuugugcagggacagcagaaaugacacgcuuugguuugccuucaacacugaucccgucaaagcacuagccucugugguguucccucucaggaccucuguggugcucccucucaggaccucuguggugcucccucucaggaccucuguggugcucccucucaggaccucuguggugcucccucucaggaccucuguggugcucccucucaggaccucugugaugcucccucucaggaccucaguggugcucccucucaggaccuuagugguguucccucucaggaccucugugaugcucccucucaggaccucugugcuuucagaaaggaacacugggagaggagacaggcaccggguugcucugugagcagacagugagaguggcuugggcaggauagguccccaagaaguucacacuuaggacaauuggugacaagcuggugguacuguuguggcagguuuuggaaaaguuaggaggugggacuuagcuggagaaaacaggucacugggaguugguccuuggguaucuuguuuaguccuguguguguucccucugccccaaccccccgggccaccauguaacaaagguccucuccuguugcccugugaugucugccuaagacauggggccaaccaacuaugguuugaguccauugaaaccaugagcaaagucaacauuuacuuccugugauggacuguauaugccugggccagggcauauacacuauuaggagguguggccuuguagaaguaggugugucacugugggugugggcuuuaagauccucauccuaucugccugaagucaguauuuuccagcagccuucugaugauguagacugcaccaugccuuggucauggugucuguucacaguaguaaaccuugacuaauacaaucccuuaaguuguuugugucaagucaucuuuuacagugacauacgaggacuuaauuccaggacuaacccccuuugcuagguccagauaagaauccaauaaggacacaaggacaaggcucuagaaggugagugauaccucaugggaacagagcccaggcaugccccuugcaucugaucuguaccuuggagaagaauucucucgcuucaggguguugagguggaagagggacggagcuaggcacacagccagguuggugggagucaucugguuuucuuucacagccgcugugacaucgcucaggaaauagagaagugucugcagaaccucccgguucucgucgggcaggagcauaauggccgccuugauggcuuggaggcgcugguccuugggaacaucugcaggacacaagcauugccaccaccaacucaguaauuuuccacgcacgugggcaaguccacaucccaaagcaaacaugggcaucaaauacugaacgggcaguuguagaaagcauacuaaagauuaauaagggagaaauuaugggcugccaccggcgucacuacccucaaguauuuccugccuugugggggaguuaaaacauuugaaacacccacaauacuaacaugcuuuuaaaucgaccucagacuucggcuccagaugacacgcgccuuaagcguacagaacuguuacuucuaagcacuuaaaaaaaaaucucuaauuugccaucuuaauuaucaaaaucauuccaccuuaaagacuuuguguaguuucaauaaaauguuuuaugugagacacgugcaagacauuaaaaaacaggggcugcucagcugagcagaaagggcucaguaucucuggagaccgauuuugacccauuugcccauucuuuaaauggggaaagguuguggaaaaacaugaagccaauuucaauagacagagcuuaaauaaugacguuuaaaguuuuuagaagguacaccaagaagcaaacguaucaaagugcacaucacccuguagaauaacuuauacuggaauaaguuugugccuggcauuccggucucauucaccaggcaaauuuucuuuaaagcaagugguggaaaaagcaagucacuuaaaugcaagguccuaagacaaacugauuaaagggcuccaugguuacgacgcauaacaaauaccucagcaggggcggguguguguguguguguggggggaagugaccuguguuuuccuaaaauaugaaagguugagagagagccugaagcaguccagaccagcuccguuucucauaaaaugaaguccagcacgucacuucuaaagcuuauuucagcacuaagacggggcugcuuuuaaaucaugcugcucugacgucacgagcccagagaaagaggaggaggcugugaaagccacgguccucuucuucaucauucacuuccucaaugguuugcccuaagccgagccuaaaagugaggagggcacgcguauugucuccuuagguguuuaugggaggaacggugaugauuaaccggaaaaggggaaagaggauuauuuuauucauuucccagggagauaaaauacacaugagaaaaauuugaauuccacagcccuguuagagaaguauaaaguaaaugagaagucuauauagauggggagcagggaaggaaaugagaggugggggaagggaagggagaggggucgagguagagaaaguggaggagaggaagaggaagaggaagaggagggaggcagagagggaaaagggagagggagaaggccagcauaccauuuugguacccuauuuuugaacaccuacugcucuagauaaacgaaagaugacaguggacuugaugguaaaaauguacaacugacuucuguacuuccugacucaauagcaacacugauuuucucuuucuuuugaagacaaugucucaugagacccagguagcccucaaauucaguaugcagccaagggugaccuugaacugauccucccaccuccauuuccaaagugcuaagguugcaggucugcaccgugacaccugguuuaugugaugcuggagagaaaacucaguacuuuaugugugcuacacacaaucccucugccaacaacauacagugggucauaaaaguacuucucaagcuauuuaguaaggauacaguaaaccuauuacacacacacacacacacacacacagacacacacacagacacacacacacacacacacacacacacacacacacacacacacacuguaacuuucgagaagaucagcaugcagguuuuucucuacaaaaggauggcauacaaagaggcugugugcuucaguuggucccauggaacccgacaucaguugccuuaagaagaaccaagaacgcuuacacugguagaucugcaggaagguuucggagaguuuguucgucaugaggggcucaggaagaucucgaaaauauugcuuuaacaugucugccacaucauaagcagacuggccuucauaguugacauuaucuucagcgcuuucauucaucuggcguagagccuggauccgggauuugacaccugacuuccugaagagcccgaccuuuuggaaggagaacagcagggauggguguggaagcaggacccuuccccacgaaacuagaaaaaaaaccaugcagcccaaagcuccgcucccacgagugggauccacaggcagcuguacucaccugguccagacagugguuacggagguagcgcauggccugcuggaugcucuggggcaggggcuguccugagcgcugcacguucacagucagugggaccccaaacacacuccgguccuuguagucuggaaccuugauccuuuucaugaacuugggcacagcccuguuuaaggaagaugggguggaggggauaaagcauucacuugucugaauuugcuuacccccccuucuuuucaaccccuccccccaccacgaauuugaucccugucaauacagggacuauuuaaaugaaaauaaagugaccucuuccguucuguagcuguaguagccacauuaaagaccuuuuacugggucaguagcugccacaauacauuauaugaguguaaaacgcccugcuccaaauuacuggacaaugucauaggaaugugugugguuuuuuuuuuuuuuuuuuuuuuuuuugguggcgggugggcaaagugcuuuugguuaucaaacuuggagacucuggaaucuaucugggcaagugcucuguuacugagcuacagcccuaaugucuccccgauuccuuuguuuuuguaagacuuuuuauuauuauuauuauuauuauuauuauuauuauuauuauuauuauguagcccacucuggucggucuagauaucugaagagcuggaacuaaaagaccuggacaaauacccucaucuggggaaucuguuagcuccuguuaaucuugagaaggguugucugugguccucagggaggcuaauggacuuccuuacacgagaacaguacaggaaggaagaggcaaaaaauauguaacacccuauuuagguacuucugauaugagcuugagaaacaacuucccacuuuuccuaaaaggguaugaaucccuucuggguucuuggaagagaccugaguugauucauuuauaaggagauccggguaacauuguguaaaaaccagccaaaggcuaacugucuugucauacugggaaccuaggccagagaucaaauagggcuggaucuggagucaaaauaaauuccccugccgaugacuccaaagaauacagcaucuccaggcuucuaugggaaaggggaaaggcacaauggggguuuugugaagcucccaaaggcggccaggcauccugaaagcagggcugugcccagccauauaugcgacagcaggaaacccaaaucaggcauuuaaggaugucaggcagguacaagugaccccuugagggagaccagaaagggcagagccgaacaggaaagggacuuugggcagaagugcuccuugcuguccgaguucuacaaugccaggcauuuacauuuugguuuuuacacacuggaaaaccugaccagaagugaaguaagugggaggguggacuuguagauuuuuuuuuuuuuugaggguuuggugagaaaggggguagacaacccugaaaggagaauguaaaauaugcaguuuuaaauagcagugaggaaaauauuacucuaagcacagagggagaccacagaaagccaacugccuugccuucugggugcuugcccgcggccauggugugccacucuugauggcucuagaaaaggaaaaggcagagaguaaagccagauuugcauuuccauacaguuaggagcagggcacagaggcagaagugugcauaaagcucgcuuuguugugcgugaagggcccaggcuguggaauguggaaagaacacauuacacuccccgcugagaaucugaagcauucugggauaaacuggucaauacguauuucugucauucagaacaaacaacuucuguauuuagcgaggcucauguaacugccuugguuagggaggugcuuugauggcacaacuacaaccccuggacauuccuaggagggaggagucagagaauugaggaacaguggacccugccucagaccaucucuaccauuuuggcugguuacugauaugggcugcaucuguuuucauaacaauuggacuacaagcacccugaugugaaaagauucagggacaccugugacacuuggaaacagagaccuggauccagauacaguucuugucuuuaaacucugacuauggacaggaauuauauccugcccacgacccauccagccugacuguccacauuuuacacucaaggcugaggauucuagauuaugaagaguuagacaucuaauacauuucaauuuuaaaaauauaguugcucugugguggggcaugguggcacauggcuuuaauccuagcacucagaggagguagaggcaggugaaucucugaguucaaggccagccugguauauauaguuaugaguucugggacuaacagagcuauaaaacagauagacccugucuuaaaacaccaaaacaaacaaacaaacuaaagcaaaaaaaaaaaaaacaaaaaacaaaaaacaaaaaacaaaaaaaccccccaaaacccaaagggcuggagagauagauagcucaguggguaagagcacugacugcucucccagagguccugaguucaauucccagcaaccauaugguggcucacaaccaucuggaacggaauccgaugcccucuucuggugugucugaagacagcuacaguauacucauacauaaaauaaauaauucuuaaaaaaaaaaaaaaaaaaaccaaaaacucaaacacaaagaaacaguauauauguaagauauuauagcuaacuacuuaaguuuauuauucucugagcauuuuugccagaaagguccgcuucuaaauaaacaacaaagcaaaaaaaccccaaagucaaaacaaaaaccccaaacuuguuagcacagguagauuucucaggucaugcucaaaaccuucaaucaaaacugaccaacagcgugauggagugugggcucagcaugaacaagggccugaacgcaucucaggcaaccacaugauggcugaaaacccaaccaaccaguccugcaguuaacucccugaggcuccaggaguuugagcagcauggagaacauagccuggaggauguggagaccaccugcuuaaagguugauggacuggugacauugacagaggacagaacgguccuaugcugagugcuggggacaaccucagggagcgugauggcauccccccagggccauugcucacugcucacugcgcgcugcgcucucuuaccagcugaagccgugcuuguuggaaggcguguacuuuuccagcagggccgucaauuucaggagcgaguauuucugcagcagguucaucugggccacagacuggcaguuaaucugcagugacacggaguugaggcucggccggugggagcucuggaagcugugccaccucagucugugccugcaagagaacagggcggaaggagugagcugggaccaaucucugaucaucaggaaccaagagcaucgaucuuccuuucccugccucccccccacccccacugucuuuguaaccccugaagguugguuccagaacauagcagauauguggacucaguacacucaggucucuuaaaaaagauggauagugucaacgcacaucgggagcacccuccccauuuaauguaaguuuauaagccagauugcuauaacaaccugcuaguaguucacggucacacucuauuacccaggguauaaugacggagaagacaguuucuccccugaguaguucucaucugugccuggcugaaacugaagauuuggaacugcaggagaaucaagaugcaugcacuuuaagcacgucuaaguacaccccacgguggauaaggccugacuauaucguucaaacaccaccaucuuccaggguccacugucugcauccuugaugaccaaagguucauaccuaguuuauaauacuccuuucccguugggauuguuggggucuccugguuggacgccgucccuaggaauuuacaggacugcaaauaucagacucaaucccaccaagcagacccuucuugauucuccaccucuggaugcaucgagaagcaacgcccuuccuuaccuauugcaccuggucagggaagcccccaccccugagucucuucuuuccgggauaucagugggcucuucgggcucauugagggaguugccugugcuguccaggucacuggguguccuucggucaugguccacauccagguguaucuguuuuggagaugacgggcaaggagagacagaguccagggcugaguccgagucucccucgucggaaaacuucucggaccacugguugacuauccgcugcauccccuucacgugguagagaaugucauccagcucagggaagauguccucauucuccaggucggccaguucucccgagcuggaguacaggauagaacccgguacguuaucauagaugcucaggcggcugcucagagagcuggaagaauugcgucucuucagcuccuuaggacugucauggcuguuuucucuccguaggcugagauggccagggccauggaagcuuccgguccuccaguucacagaacuguuucccgagggacagaaacugccaugggagagggccuuagggaaggugccgggcuugugaucuucgggaauguagaacaccguguccucuggguagcucucacgguuuuuauaguucugcuccgucacguuguucaagguggacugacugaaugggucgaagcccucuagauacaugcccacccgcuuguuacaggugcugaggcuccggguccuggugaccgggcugggugugcugaccgcgcugcuggucucugauuggcugcugcugcugcuggucuggguggaguuagacacgcuccuuuuccguaccaugggcacguugaugugguugccauugagggcugagaucuccacacaguucagcugcuucagcuuugccucauccauacccuccugcagaaugggagcacugaugaucaaccccagcuuggaaggcgccuugugcuugcuguggugggagcccuugagcuucaggcucuccaugcguuugagcaggcuccgcgucuucgacuugguguucuucucgugguggccuuucaugcuaaaacugaagcuggacaguuccuugggagacggcaggcuggaaaaagagucaucauugccuacaaaguguccggaggagcagacgcugaugacggaauugguucggggcguaguggcaucuccacugugggcugcguggguggggacgcugcugcuggugcugcugaggcuucggacagaggccaccuccuggugcucgcugaggucugucagcaugcuuucguggcuuguggcgcuuugcaaacgagaguugucuggggacccagggauuggauccugcuuuggggaaaagacgucaaacucuucaaggcgggaccaccgcuugcugucccucuggaaaguccacuugccgcuuauggcgcaaggcucaucuucauccgaauccucacucugaaaacacagaaugaagccauuuaugugcugggccaagcagggggcagaaggcagaacacagguuaagggccaggccacagcccaaaugauauucccaguguccauugcucaguucucuuaauuaacaaagauggauuuaaagacauuauuauugggcuggagggauggcucagccguuaagaacacuggcugcucuuccagagguccugaguucaaaucccaacaaccacaugguggcucacaaccaucuguaaugagaucugaugcccucuuucggugugucuaaagacagccacaguguacuuauauauaauaaacaaauaaauccuuaaaaaagagauauuauuauuacuuuauuuuauuuagagaauguauuugcauguauguguauauguauggauguauaugaauguucacaccguguucagacgacuaccagucagugugaguuuucuccuucagucauauagaacugggucgacaggcuuggcaacaggccgacugucauuuaaccagcccagauguaaagacuuuaacagaagucugaccaaguguugccagcuaaacaagucauuuuauugaaacccuggcucgucgggccauucacuaaucgcucacaaaggggaccucugagaugggcgaaaauuccaagcaugcaaaauauucugaacuggaaucggagucaacagucgugggacucccucuggauugccuccaguuuaacugccuguugacagaguguguuuauauacucgugugcaauuaaaaaaaaaaaaagcuauuuucaaacagcagaauggcagcugaggacucuaggucccaaagagaaagacaagguauuucuuuaaaagaacugaagaugauauagugagccaucuguggcagaacaccugacuauucccuuucugaagggaaauuagaagacaccacucagucugcuggccauccuugccacucacguggaaaaucccacgagggaggcugaguuuguuaagacaccgaguacacgguaucacacaucaauguggagacucacugccaagcucaguggacaccgccguuccagcucgcucacgugaaacgguuaacuucccagauggacuguauacucucaaccgucaggaguacgucuuuuugggcaaauuuacuccucuuuaauuuccaacaccaguuccucacuggugagcacugacucacccuuuccaaggucucauagcucuuacccagaaauaacuguugugugacccaccaccaacgacagaguguaugggauuuccugcuccggcaucuuccuccccacccaccacaucuccuacaguaucccccaagccagccuuccccuuucaucuugacagcuucgagauggagcuacuguuccauccaggaaacaggaagagguccuacagaacguuagcuuuauuuccucuagggagcaaugugaaauuccucuggagauucaauaggcuucaugcuuugaaucacaugguagccauggaguucacugggaaaaguaacagauuucuucaaguccagagcaguagaugccaccauccacugcugucuccaaauagggguuuuaacauguugaggaauggacaaacaggaccuuuuacagaguguagauacaagucuugucuugguuagugugccugcugucccugcccuccccccuccccccucccccccauguaauuuugguacucacucgcuuccggugaggacugaucuccagcuucaugacugcacacuuguuuagaguauuuaagcgccugcagagcagagaaaggccgugagcagagaaaggaaccacgaaugggcaaucaaacugaacaacugacccauacaauaugagcuucuccgaacucauuucuaguuuaggcagguaugcuacacuuccauuacauaguggguaauggagucccaggaugguagugcacgucuuuaaucuuaauacccagaaggcagaggcaaguagaucucugugaguuggaggccagccuggucuagcuagugaguucuauucucaaaaaaaaagcuugucuaacacaaaagugccauucuauuucuuguuagauggcaugcuacagcaucaauggcaggcccacuucaagggcaacaggccagcaguaggaacuggggaagguugcaggcaaagugcucagugcacccuucucacucaaguaauaauuaagaaggacaauggaccucagaaauguccaugucagaaggugacuuuuauugcuugaauuuauuauacagaggugaaguuccagcccucuuuauuacucaguccuaucaggagagacuguuuucaguaucgacagcaacugcacaaaugauuauuuuaaaaaucucacugagcacaaacaggcccuuagaacacaguccccgcugagacgggagucaaacugcagcuuugaacaagcugcccccaucgcuaaugauaucgguuuagccacauuagagaaacagggacggcagaguagcuuagugaucggguacuugcgaaggacacacaaggcuucagguucaauccuuagcacaauggaaaucaaucagucgaucaaucaaccaucaaucaaucaaucaaucaaucaaucagucaccaaucaaucgaucaaucagcuucauuaaaagucauaggagaaaaaaaaaaacaacaauagcacccguuaucuacucacuaccuagugugcaaagugugagugacaggucccugggccucaguucuuucuagaaucuuccagaugaucaucacuaaagucuuccuuuuuaaacgcgucugcuuguugccucauaagcuucacacacacacacacacacacacacacacacacacacacacacacacacacacccaucagucuuuuauuucuuucccgaauugcaaccuugcuuuuuuuuccccauggaauaagagcgcuuaauucccuccacuuggaacugauccuguacccugcugggcuuuaucucgaggguccugcucugacaacuuggaugcaccaggauagguaguaucucugcagccugagaagccugccuuugauucuauagauuauguggaagccuguuuauagaauaauaaacagagauaaaacagaauaccaacucguucagaaaaaccucuccuugcaugggaaaggagugggggagggcaggaggaacaguugagagacacuggaggcucagaaggguguagggucccuugcugaggggucucaguuaaaggacacaaccgaauguaauguuucacucccccaguuuuuuucaaggcuuuaagagugagcaaugguuaaguuagucuuaggucugggauucauuaaucgaacccguaaucaaaucuccacuggacugcauuggggcuuuaauggcugagugguguuuauaaccaaauuuacuaggcauggaggcuuauggggcuuggggaggugggguaacuucacacacgccaguuuaagccaaacaacaaaagacccaggagguugguuugagaaaagucaacuuuaacuuuuuauguuggcggcaccagacuaggggugugacgcuuccucucuggguuucugugguuuuucaaugauuuccccucacccacccacaugcucuaggaucuccaaagagcaggacccucagauuuccggagggguacuagggacauaagauaguaguucugaucagagaagaaacucauuucauagaagggaacagaaagauggucaccagaaguugggaagggacagggagucgcaaagaggcaggcagcaagugcagggcgacuuggcauaccagggugacuauaguuaauauuaauuuuauauuuuaaaauagccaauuugcauauacuccagacaagaaaugauaaacguauaagcuaucggauauguuaacccccauaauucagucauacaccuuacacacaaacauugaaacaucacuugcuaccacauagauacauacagucgugcucugucaaccaagaauuaaaauaugguucuaacuaggugaacugccacugucuuugggugaggcacuggcucgucuucaguccucugacaaccuucugccacagauacuaugauuuaucuuuauuuuauaagggacgaaaggggauggggggguggggcuuagagagcuuaggaaucuugucuaagaacccaggauuaaaacacaguggcucuggugcccaaagacagcaaccucuacaguugguugugaaacaaguauuaacaauggccgaaaagaaaagaaaauauagaaaagccagccaagagaaccugaaguaggaucaguaggugagauaccgauaucaguaaccaucuguggccuugggcauucugaccccgccgccacccaaggcaagggcccagcaggaaugugcaggucuuaucucuugggugccuuggguccguuuuucaagacagauggagccaaaggugcaaugucaaagcuucaagagcuuugcggcacaggguuggggcuagggcuggaggcgcacagaugaaaggagagcagguggaggucugccccuucuugcauuuaaaauaagacagaagaagaaauaagaaaacagaggcucccacaaaaauucuucaaauuccuguagguuuuccuggcauucauacaaaaaaaauguuuaaguuccuuguuuguugcauguagcacuugggaggcugaggcaggaggauuguugaguucuagcccagucuggucuacauagcaaaguccucuuccaagcauccccuaccuucccacaauuacuugcuucuuuuaaaacugaauaguaagagcaacaagguuagaaugucucugcaaugcuugacacggcuuuggcaugucauggugauuuggggacaaaguacauacugaagaugacagugacagacaacauaguuuuuuguuuuguuuuguuuuuucauaugacaacuaccagcugauguucacaauucuuuccacguguugguagaaggagucaguuuuaacuccaaaggaaaacagcggucugaaauguuccugaagccacgggaagacauuucacaagaggcgucucagcauggcucacgguuuacaacaccacaaguaugugcuuugagacacacugaacacucuuccaguccggaguagagcuugcucgugaucagagcuuccucaauggguuuagguuaucagucaagcuagcaagauugaggggaaagaauuucuucaagggaccaagucaucugcuaccuuagacuaacacuuuaagaacacugggcagggggcuggagagauggcucaguggguaaccgcacuggcuguucuuccagauggaccugaguucaaaucccagcacuuacaugguggcuuacaaccaucuguaacuccaguuccaggggaagcuaauguuuucuuccgucuucagaggcacgguacauacacuaugcaugagguaaaauacucacacacauacaauuuuuaaaaauuaacaaaagccuacuagcauaaucauuauaauuuuugaucauuacugaacuuuauauuuuuagaaagaaagucccagugcuccaguccagaggaaaucucugcaguaggcauaugcaguaagugaagaaucagaaagcccacaagggaaggcucuugaagucugccucagguccccacgugugcccuucuaugaaagcccaagccacugccauuaugugugacuacauggacaagggccuugggcaucccaccucccaauacuccaacgacuauuucuauggguucggaauaauuucucucuuuuaauuaaaaaguaauuuuuugagggacgaucuugcuguguagcccagacuggcuuugaauuaccagguuuuuuuuuucucccucugccuccccagggccgagaugauagugaacacuuacacauugaauaagaauuucccuuaaaaaaaaaaaaggaaaaauggaaauuuaagucuggucuuuugcacauauccuucaaacuuuuuguuuuaaacuauuacaccucacuuguaugaaguauguuagcugacccagaaugcaucaucaaguuugaacgcagauaaagcacuacuuuccuuuagguuuuucuuuguauggaucuagucuuuuuucuaugggagguggcuucuccucucagguuacgguguucagagccaagggaaaaucaaacuguagagcaugucuuuuucuuuuuaaaaaagaaaaaaguugauuucggacugacguuccaggaaaaaaaaaauucuucaagaauuuaaaucgcaacucuuugggggcugaaguacugcaaugguauuuuccugacccagaaauuccuaagcugcugaugugguucggaaggccgacucccaaaguggcuuaacaugugugagaugaugggugaccuaacacaaagcucaagaauuuccaaagaugccucuuccaaaugagcucauucguaugcauuaccagcagugaugacuugagaauacauuaauucugccaccacacagcuaagcacgaaggcaucucuacaauguccgcggcaggcagguccuguuccagacgcugacuucucgcccacuccaaaaaggcgcuggugacauugcgcucacuccagaugcacacuaacuugcuuuucccagaaaaaugugugcauaccccuggacacauguaaugaaagcugcacauuguuucuuggggguaaauaugguuucuucuuucuuuucacagacuaugaaaucuagucuuuuccauaugcuauucuaaacagauaaccucuaucuuuuccucaaacuucacuauucaagcuuacugcuucaaacaacaucauauaagaaagugugugugugugugguguggugugugugugugguaugugugguguguguguguaugauauguuugguguaugugugaugugugugaugugugugugugugugugugguaugugugguauguguguggugugguguguguguauaacuuucaaagccauuauuguguucuucacauacacaggaauagaaacaccagacaucauuucaccuuaagauguuuuccccaguuaaaguagacacugaaauuaagaacuggauggagagcccagucaaggcaagccugagggcccaagaggaucccugcaucagguaucacagcagggggaacuggugaacacaucacacacacaccacacacacacacacacacacacacacacacacacacacacacacacacacacaccccuccagguucaaggagaauuugcuucaaaaaacaaggcacaaaacagcacuggaggacacuggauucuaaccucuggccucuguaagcacuugugaaugugcgagagcucucucucacacacacacacacacacacacacacacacacacacacacacacacacacacacacacacacggucuuuuacuaagucauugaaacuggccucuguaagcacuugugaaugugcgagagcucucucucucucacacacacacacacacacacacacacacacacacacacacacacggucuuuuacuaagucauugaaaagggaacugauuguaacuuuacauucacaccaacaugugaacucugccuauguggagggcuaugaaggcuuuuugguuuugagaaaaauuacugagaacgucaucccggguuugagaggauuaucugaagccuguguauccucaggauuuuauuacauucacuucucuuaaaaccccaccggcugcuuuucagccuggagagcaaccagcgcucugaauggcaccucugacagcuuuauucaaaguucacaucaaugcauguuuacugccugucuccuguacauuaaagccuguacucacugaguuuacggccuacuuaauccugucagcacucuaccuggggcagcuggagguccugaggagccuccuuggaauuccaggacaacccugccuggcucuaccuccuagcccugcccaugacucucucauuuuacuccacacaguggcagcuuugacucccucacuguaccugaggccaguuccauuaacucuucagaaggguugcugcuuuugcugucaaaugguaacaaaauaugggauggugcuacccgagggccuccaaggacagccagcauuggaugcuauuucaguggcacuauuacauaacagaauuuuacuucagcguucaucaaacggucuauagcacagcagcaucaaucacugugucauuugauaaucaaagaccucaugugguuuaaaauaaagcaaauuuaucaaucauuuuuuuuuuuuacucucuugaggcagggucucucugugccgcucuggaacucacucuguacacaagguuguccuugaacuuggcuuggggccugccccugcccccugagugcugagacugaaguacuguguuuuuaaaggagaggaaaaugucagguuaccugcagagagccucgauggcgucucuguccaagaagucauguucucucuugaccagcgcaauaucaauagggaacaguagaucuguaagaagagcaaagacaaggacguuuguugagagcccaggaucuugacaaauuagacucuucuggcaagaugcugaguaucuguggcccacguuuccuagcaagcuguguggaugcaggaaacagcuugugacaacucugugcaggucuaaaucaccucuaaaacacuuuaaaaccuccaagguugcuucguuguugcagaagugguucaaaauaaccagaaggcaguaaauacccacuggaaguuauaauugaagcuagaauagauccagccaggagucuccuuuguuauguggcuuaaaccaaaaauguccuugcucacaagggaccacagggaaaaaaaaacacaaaaaaacaaaagcaaaagcaaaaaacaaaccagaauucaggccaggaaagacagcgaacaauggccccggggcaguuggagggaccaguccauuuacaugauaggacggacgcagagaauucaagauaugcuauuuuaaaacaaacauuagcauugccauauggcaagccaagggauuuuucagucccagugaaacaaaggacuaacucuaaaguuacuguaaaacacuagcacccaagccccgacaucaguaagaguccaguucucucagaacaaugaaccacgugcauucgccugagagaugggagaacucgguacagccugaaaaaagauuccuuccuguaaggagccugggaauauggaggacuauagggggagggguggacaagggcuguuuaccaacuacagacaggaagcugggggaggaauaacuuguaaugccauccagugcugcuacuaagaugccuaugagugacuaugacugucuuuucaaaauggcuaggagggagagguuacugaaagcuuuccuaggcaaagcagucgcaaaaaucugggaugcuagcuacucuugauugcucuguucugaugacuacacacccaggacuacuuauugugugucaguugaaaauuuaaaaaaggggcuggagagaugacucagcaguuaagagcacucacugacugcucugccagagguccugaguucaagucccagcaaccacaugguggcucacauguaauggguuccgaugcccucuucuaagugugugucugaagacaguuagagaguacucauauaaaaaaaaucauuaaaaaaaaggggggggcauacaccuccaugccuggcuuucucuaucuuaaauuaaaaaaaaaaaaagaaaagaaaaaagaaaaagaaaagaaagaaagaaaagaaaauuuuaaaaaugcuccuugguucuagguaugaaaauaaauaucccuucaauuaugagacacgauacuggcaccugccuuuaaucacagcagaggcagguagaucucugaauuucuuucuuucuuucuuuuuuuuuuuuaguuuuucgagacaauguuucucuguguagcccuaguuguccuggaacucacucuguagaccaggcuggccucaaacucagaaauccaccugccucugccucccaagugcugggauuaaaggugugcgccaccaccgcucggcuuuuuuuuuuuuuuuuuaacuuuuuuuuuuuuuuaaucugaauuucaagcuagcacgguacacauaaagguuuuagaccagucauaaugacagugaaacccuauggauaaaugcauccuguagaccaggaagaaggaagacacccaggaacgacggaaacaugaccaucgcuccaaaauuccacuggguaaaaagcaagcuacccuccagugcaguccaguuauugauguugauuucuggguuucacaguaaaaagcacacacaguaucacaagugugcuuccucugggucaccaaggggcagaagccauuaucccaacaggauuaucaucaucaucaucaucaucaccaccaucaucaccaucauuaucaccaucaccaucaucuacccaauuccccugagcucugaagaggaaacgcuaccgccggguaggccuggugaggguggggaguuauagcuaacuaguuaugcccuuguucccgaggugagagauugacuucaacauuuucuaacucauaaucacugguuuuacacaaugacacagaauuccuaauuccuaaggcaucccuuuuuuagggauaacauuuacagcagcuuuucaaaaacaacugggaacgcuaucucagcauuaguauuuucuuccggaggcaaggguuagauuacucuuacccugaugaauaauauaugcugacccagcacacaguuucagcucagugacuaacaaagaugugcauggaccaugguauuccaagcuuauacuucuucaucgguagacagagggaugaccacacagugaagacuaaccaugaauaugaaugcgaauuacuaaacagaacccagaccacauagcccagccuuugggggacucagaguuuacuaaacaauaagcccaaaucagagaauguaucuguaggaaauauauaauaugaaacuuagaaaugugaaugcaaaguauuauuucugucuguuacgccuacguggaaaagcaaccaagcuauuuuagucaguucuaacuuccuuuaaggucacuuuucugauccaaaugaacaguucugucuucuaaaaacauccagugauggcuuggaggaggaauccaagaacucaauuuucucuuauuugcucgaagguuuucugaaggaacugguucuuaaaagacgauaguuuugcugacgacagaaguacagucugaacccaacuuccggguuggguuuagaggcaggaaguacaaauauccagguuccaaauggaccugugggcugcuacccuccgaauguaugcguauggcuuguuaaccuggcacgggcaggacgaggugggaaaugacugccuagaucucagcagggcgcacuucagagucagcuuaugcuuuaguugacgugggcagguccccagguaccaaaccgggagaauggaguaagaaaggggcuggaaauuggauuuaccaaaaccaacaggcacaagaaggugccacccaguagcacaucagcaccccaaacggacauaacuguaggaaauggaguucuuaaagaggaaaacaaaagcccaccgcugcaaauccaauuagcuuuaucucuaggagagcuguaaauuagaaaagucacaaguccuguugcagcuuccaucuccaacgcccuuuuagcaggucaggaguucugucugaaggcaagaaacuccaccacauuaaggagaguguuaaacaucaaauaaugggaugaugagaaauuucagauaggcugugaaauugagggacaguaagcuacuccaggaugucaaaaucaagagucacccguauguuuuagugucuuugguauaaaaagguacucuguacccugccaaaagaggacaguaaaugccuguccagccacaaacccuuugacuugcagugguguccugccugcaagauacacucuagggcaauggcggcucauagcuugugggaaucaccagccaauaucugauuugacuuaaggccuacuccaugagauggaacacaugccugacccuguuuggaugaccaauaaucugagacuagagagcccagggaccuuggguaaaagcaaauacuacugaucuuaaaauaauaauaauaaaaaaagacuucuaaugauauuuuuaucucuacucauagaucagugccuuucuuagagaucaugggagaagcuucauucugcagcaaaagggaacaaacagagacucacagauaaacauuacgcagagugagaaaccuuggagcucagccuuaaauggcaugucuucaucaaaucucuccccucggggcucagggagcccuacagaagaggagggagaaagaguuuagcuguaucaggagagagagagagagagagagagagagagagagagagagagacagaaaaagagagagagagagaaagaaagacagagacagacaggcauacacacagagaaagagagagacagauagacacacacacacagaaaaagagagagaaagaaagacagacagagacagacagacaggcauacacacagagaaagagagagagacagauagacacacacacagaaaaagagagagagagagaaagaaagacagacagagacagacagacaggcauacagagagagagagaaagagagagagagagagagagagagaauaugaaguuaugaaguuggguggguagggagguggggagguggggaggaucugggaggaucuggaggaaaggaaaccaugaucaaaauauauucuauaaacauuuuaauaaaaauaauaaaaauugaaaauuuccaauccauaaaacgaaguucacuacuuuaaagcuguaauuauuauaaaacaauuucaugcacggauacuagguuucccauucaaaggaacagcuccuacaucucaguggaugcacuguacacaucagccuacagacccagagacccagaggaugaguguccuaguguccugucaacuugacacaagccagggucaucugagagaaccacaacugagaaaaugccucugucagacuggccugcaggcaaguguggggguggggugggggugggcggggccacuuggacagguuguccuggguaccacaagaaagcaagccaguaagcagcacuccuccauguccucugcuucaguuccuccacacagguuccugccuugaguuccagcccuaaucuuggugauggccuauaaacuguaagaugaaaugaacguuugucucugccagucguuuuuggucauauuguuuaucacagugacgaagagagcaaauuuguacgguggucuuuuaaauuuuaauuuuccugucuugguauguguaugaaugcaugugcaacguguguguuuggguggggugcuccugcacagaucugcauaugcauagggaggccagaguucaaugucccccaucuucuucagaaucucuugccaacgugauuggauaaacauuuuuaaaggcauagcuaacuuuggagaacaauuggccuugcugauuaaacacacacauagacagacagaaagacagacacacacacacacacacacagacacugaaauacauagccuaaugacacaaaaagcugcucauuacuguuaaugauuaagaaaauggagugauaauccauagaucucuuuuuuuaauucaucugaaugguaaaaucuaaaguccgaguacaugugaacacacagcgucuuugcuuuacuggcaggagugaaagcuaacacauaggcugugggggaaauuguguauuacaaaacagaguauggggucgacccuucauuaaccagaguccuuauuucucgguugugugcaagcuaaauuauucugcaccuguaacaaagcauagccccaaccaauguucagaaguaaaaguuuauaagaauaaaacaacugagaucgccaccaaccagaguauagaaagaauggucuuaaauuuauuugauggaguauuauacaguagucuauuauaagaaaaugagcuacaggaacacacagguuagaggaaucuuaguauauuauacgaacaaaucaaaucuacauaauacccuuucuuccuuuuugaaaagguauacauuacacgaaguauaacuuuugacaacuucaauaaaaucacagaaaaugaguauguaaaaaccaauagaguuuucgggacacaggugacucuuugcagagggacgagaugacuccguuauuaucaagggucuacuuuuucuuuuguuuugaauggagucauggauacuuaucccauaguacaaaaaaaaaaaaaaaaggaauaaauaacaaaaugucuccaaauaacuccuagcucaguauugugcaugaacucaguauuauaacaacgaugacuuaaaauaagccgucauucuggcuuaccuucauacagcugugcauacugggggaaaccagucacucucagccagucgcaagcuuccuuggcuucaauuucuagagacaaacagacacauuugugagcuacguuaucccccgacgugguucuccugcaauaaugaacucauucuagcagaccaguagaacacaagugcuguaaagcaauauauaccaagaggcagacgcaccaacaagaggagcucgacaccagauggcuuacaauuuuauacauauuucagucuuuuaaaaaaagugaauaugugacucagugguauugcccgugcacaaaguccugguuuugauuccccauugcugcagaaaucaaaacaaacuaacaaaccaacaacaacaacaacaacaaaaccgaaacaaacaaaauaauuccaagaugggguccuggcagugaauuauucccugcugcuucuggacaaagggaacaagcauagugagagugcagaagggcucgaauaacuuaucugaaaccuaguuggcuuaacaagacauauugucuucugcguuaacaaagcacaccagacacacccuuacaccuuagaguagaacaugccugagccccuggugacacagguggacugggcacuuucacagccaaacacuaugaccaagugccuuuagggacacaguauucaccgggaagagagagacucaggcugccucaggaaaccgagggcaugaagucacuaguucccagccaucuuggcaggcuaaaugccuaauaaaggcccuagcucccugugguuaaacaucuuguagauaguauugauaaacagagaggccaagagccucugacagacuguguuaaaacucacucaagcacguauuuacaauccuguuaaaacugacucacagaggagguccgggacacauuaauuaguuucuguguuugcacagggaauauuccuuucaacuccucuucccaccuucuucaggcccugagagugcuuaguuauuuaaagcuauucacuucuuuauaaaagccucaacccagcuaaaucaaucccagauucccaucuucauuuccauccaccgugccagaugucagucuggugggcacuauuauaaauacaucauauuacuuuugucuacuagcuuuaacauuuccaacuccccacugccucccccuuuuuuucuuuuggauaacuuuucuuuuccuuucaggaaaagcaucuuugaaaaacuuucaucacuaaggcaaguugcaauaucguuacugggcacacgccaaggagaaagcaagcugugauucuccaugcuaaguuaauacccaaacugaaaugaggaugacccugggcuguuauuaaaaaucaugguaaacacugcucucaugaaucauucuagcgcggcgcuaaaaguagcauuacugaacaauggcugcgggaccugaggaugaggagccuggagggaggacgugcagaagacggagcgucacugugugcacagggauguguaccaccucugccaggugugugugugugugugugugugugugugugugugugugugcgcgcgcgcgcgcuaaggggucacaugaggaggccggagggcaauucucgcucgccuccagccacacagaucucagagccagaucuuagaccauaagccuuggcggcaagcaccugccgagccaccuugccaggccucacacuggguuuugguuuuugucuuuuuaaauucacgucuugucuaaguacaggaauuaagaaaguuuuaaagaagauugugaaauggugggagggggcuagcgggaggggggggagagagagagagagagagagcgagagagcgagagagagcgagcgcagcggugaggagccagguucaaaucacagcacccauguggcagcucacaguaccaggggauccgauaaccucacacauacacacaugcagguaaaaccccaaugcauagagaauaaaauuaaaauuaauaauaauaauaauaaauuguaaaacagcuccuagaagaguauuaugagagagagaaaaacaaccaugaaaguucaguguuuuauuuuagagacuaaaaaucacauuuucccucggccuagccuuccugucuuccgaagauggcuaccggaggaaaagaggcugcuuguuucaaauaagccuauuaucuuuuaauuauuucuuuuuggagauuauuuuacaccauuuccucugcuuuuucuucccuccaaaccuucuuaaauaucucucuuugcuuguuuacaaacgcagggccuuuuaaacauacacacauauacauauauacauacaugcauacacacacauacacacacauacacacauauacacacaugcaugcaugcauacagucugggugcuuugcuugcacauagaucuguguuccaugugugugcuuggugcgcagagaggugagaagagggugucagacccccuggaccuggaguuacagagggcugugagccaccgugugaguucugggaauggaaccacaauccucugaaagagcaacaagugcucuaaaucacugagccaucucuccagccccacaaauucuuggccucuuaaaaggauaguuaagauaccucacuguuuccacguccuuagagacuauuuuuaaagaacagacuguuggacauuaaauaauaguuaaaaaguaauguuugcuuucuuauuauuucacuuaaaaaguggcaaguuagcuagaaauucgaagcacccgcccaguuuugggcaugucagagagugcacauacaaggcccucaucaggcgcuagagucucagaccuauuuacacauguucccaauauucuuacuaaagcggcuucauguugaaagguaugugaaagaggcaggauauuuuuuuccaaaccaucuuuacauguauaaacguaauccuuuacauaccacaagaacuuuucacagacauuaauccauuaaggucccaaucaaggacaucugaggcuggccugagucucaguuguuggcuggccugugccucucuguuauuuuauaucauuaagaaaaugucauguucucauucaagccuaaacugacaccacacagucacuucuagggcugcucgguuagaaaagaaaugguguggucuggggggauggcucugugggugagaacauucacucugcaagcgagagguucugaguucaaaucccagcacccaugcaaaaacccaggcagacagguagacgacugagacuccugggaacaccaaacacuaguucauuuccccacacugauccuaauaucugcucacaucacccucaagagaaaugauccuaaaacacagauggaaguguuuaaccaccuuucuucaaaaaaaugagcuuaaugucgcaggugagugagggaacagggccacauagaacgcuaguuucuuuggaauagaguagacuuuuccuuuuggagggaaaaaaaaaaaacuguagcagugaaaaaguuuaagauauugaaaaugagcccgggagguagcuagguggauacaugguguucuugcacaaaucugaucagugcaguucaguccuggagccuaggagagaccuggaagcuguacucugaccucugcauacauaccacagcacgaacauaggcguguacgcgcgcacgccuguacgcaugcguacuaaaucucagagcccaccaccagaagccugugcgccaggaccuuagcaucucccccugcucucuagcaacacuuccaccuggcuccaggguagaccuugagugcagguggauggugcuuugagagcagcgaggaugauggguuuaaaacagaaaggccuccggagacuugaaaguacaauggcgacacaaugaagcuugcagacaaggguucugcuaagcaaucgacaggcaaacagguuaaggaggaaacgggaaguuuuucuuggaagcagcuuagucgcuggucagucacagcucugcacaugagaugaaugagcgcuaagacccuuugugcauggcugggaacccuuagcccguauuuacacauuuccuggcuggcugggaugccccuuucuuccucccccaacaccuuaaccuuaagucugcagacggucccuuagccagccauccugccgcugagcucugcuguucugagcagaucaagcggucgcccagaagucuaaacaggcugcaauacuuccccagugggaacauguggauuucuuuccuucuuuccccauauaccugcucaucauauuucucccuucaaagaaaugccaaggaaucagagaaugcuacaaaaagaaaaacgcaggcacuuucccccaauuccuugcaaguccugaaguaagacagaugugugggcaaagguucauguguacagagagcuacgggcagacagggguggggguggggcuuucaaauccaaaccaagauuccuuccuggcccuggcugacagauuccuuccaaagggaagaagaaagcggccagcuuaucugucucuccgcuaggucaaggaggucagcaaugcacacaauggcuuugguaacagcccaccuucacccagagggugcggcucauggaugggugggucaucugcagaagcauccuggcccacaaaggaguaagguaguuaaaauaucagggaccagaaugauucuuaacccuggagaagugguaacacugucuugaaaagacuuuauacaaaugccaaagaccauccaguccacagcacagacaucuucuuuuauaaaagcccucuaagcaauguacguguaggcaggacugacuccccugcaucuccccacagcauggucucucuccagucacuaguguauucuagggucuaguauauucuuuuguccuugaaucucccuuugacucuaacagauuuugaguaaaccucucuccauccuuaccuccagcaagcucuaugggaaccuaguguggauuucccacaccacauacuucccuaugucccacgcugcuuggaacuccucaacaacuuccuaucaucuuugagugacaauccaaccccuuagccaaguccuugggcucuccuaccuuggccucuuggcuugccuucucagcucuugaaaggccuccaguuggaagcucucuccguucccaggauacccuggcuauccagggcugguauucucuuuagacuucaauaaacacccccaucuucaccucaccaacuuccuccuuaacucaaguacaccccuaaaauacucccuuuuuguaccccagaaccaugugcugauugguuguaaaaaugcaaagaaaaaaaaguccaauuuugaaauuuucauuucuucaaaggcagacuaaggacuuucacuugacaacugcaagaauaaauguuaaacacacacaacugccaacucuggcuaucaggaguuaucuauguaagaugaauuccaacuagggccaagucacauagaauacuuacuugauauuuuuuaagcuccaauguuaucuaaucacaggaaagauucugagagcagcgaggcugcauuccuacccucaggugccuaaaagaaaauuccaagcaucuauggcauauauucuggaagcuucuugggagacaggguaaucacucagucugggcuuugggcagacccaaauccaccguggggcauuaaguaaagcaagccagccuguauauucuccuucguguggucuggucuuuacuuucugaacuaggugagcggccagcuaucuucagggaugaucagagagccccaaguuccugccaaguaggaggccagguggaaaggcuugccacagcccucccccauccccccacuucacccccaaugcaggggccugaugacccucugcccuugucucuggaaucauuuaguuacucaaguguuccucuagggccugggaguuuguaaagucccaagugauuuguuaagucagccccagagaauccccuucccagugggaaguccuguggggagcuucuaaggccaggcugcugacugcaccccaccuaugcccacucugccacccaauacuacccgccccucaacugauccagcaucccuggcuucucccuacccacgccccuuagucuuccuucuucuucagcguguaccauguauguucccugagcccucucuguaagcuccaagaauaagucuguccacuucguucacggaucucccccaaguuccacccuauuuuguggcagugugguccuccaguaaauaaauaacuguguagcuaaaccauugauuuaauuuucauuccaguaaucguuaauuuugauuaacaacuacagcaagaaauacacuuuacagauuaacaugcauggauacaacaguaacaucugagugcagauguauguauguauguauguaugugcauguaaaccucagguuucauacaacaguuacaggcucucuaagcgucugccucugcacugguauuuccuuucugccuaccaucccuucucuaggacauauucccuaaccuuuaacauccagaauucucuacaaacuauuuuaggaacauuucccaacauuguguacauuuguugaugcuucugcugccaaaaauguauaaacugcuuuuuaaggaagcaaugcucugauuuguuucaugaaagguuauguucaugaauucagagaacacaauacccuaaacacuugcuucugcauggauccccaggccccaaaccaagcuuaauuuucacagaaaacccuccagucuauuaaaaaaaacucuuagaauuauauauauauguauauuacuaucuaucuauaauacuguguuauauauaaagauauauuuuauauauuuuuaaaauauauauuauacaucaguauaaauauguauguauguauguauguauucuuuaaaguuuuacuucuucccuggcauucugaguccuggggaggcagggaacagggugcugacauacacaugggacuuuuuccuguuauaagggugugguccggaguuuggacaaucugcuggaauucagaggcaccagaugguguccuccgcccaaagaguuucuugccuauuccacgguagggagcucuuaaaucacucauguggcucucaguacuauuaaagaaaaaaaaagaaaagauggaagcuuggggcguuuucuaucuacccucuugaucuguugaagauuggagacagagaugcugcuuucuaggaaagaaaauuccuagaaauaaucuaaggagggggauaaagaagccacuuuccccccugugaugugaugacagcuuaauaaaggguuuuacucugaaagaaggaaaccuccuccauggagacauuccacaagccugcacccggaccgaccgagcacuugagaugacaccucaaugaagcagaaaucacggcaagugaaauuuccucuggggaauccuuuugcccaagcaauugcaaaguacugcuuuuaaccacucaaaccaggccagggagugguucccgucacugccauggugugcagaagugaggucccgagugacagggcugucaggaacuccagccuccacauuaauguacuuuauucccaggaauagaaaauaucucccagcuaaucaaaaacgggcauccgcgcuccaggaugaagaggucaaacugaggaggaccugagcuacugaggagauaggugcagcaacauccccucucucuaguucuuggcagucuagagugggauaaaaauagaccuuugcugcagcaccucucuaccccauccgccccacagcccccauccugcuuuuaugucccaugaugauauuggacuguaaagcucauuacuuugaauggcaauuaagaaaaagaaaguccauuaggacagcaccccucccccaucugucaaucaauauacauauguuaaugcauuucuaggacucuauaucgaacacuuaaagacuuccaauuauaugcuaaggaaaauuaggucuuagggugcuaacuacagacauuaagacagcuucaaaaaaaaaagaagugucauagcuuuaaggugccuuauuuucuaaagccucaaguuuguaaaaggucaugucuugagguuguacaaucaguuucccuuuaccacuuccgaaggccaaauaccugauuacaguccuacagccugccccaucucuguaccauucaucgaucauuucucuccgcaaaauagcaaagcuuaccauucugcaaaggucagcuccccaucuagccguuugccccaggguccuccaggaggaauagaacagagaaaauaagacacugaaaaucaggauguuaccugagccuaaaauuagagauaaaggggaugggaagguauuccgacggaaacaaaacagcagcagacacaaaagcaaaaccagucuaguuaguuaagccuuaagccucuucugauagagagagagagagagagagagagagagagagagagagagagaggagggagggagggagggaggaagggaggaaggaagggagaaaagaaggaaaaaagaaagaaagaaaauuaagaaaagagugaacuacaaugcuaugguuuaacaaagaccaaugaaaacacaaugaggccagugcuaguuaaagguguaaguuugccuccuccuuuggucuaaccucaagcaaaaaggcuggcguuuuuguuuggguuggguuuuuggugguuugaugauuuaaguuacauggugugaugagagugggauauccccuuacccagucaaaucuguacuaaaaaaaaaaagauaaauauaucaaaauauagaaauuaauauauauaaauauacuucaaaauauaaaaagcauauucccaucuuccagauggauuaagaaaucauuuucuuuaaaauugcuuaggaccccagcaccugaaguacacacaauuugauaguugaauguuaacucacguugaucccuauaaauacauaaagguucccauuuggggaccuucccagucuguuuacacacaccagcaggaagggguccacaaugcuaucccauugacugugaccuuggacauggaacuucugucccagcugccucucagcaggggacaggcuuuucaaggaugccuuugcaaaguucuggaauuucccuuggggugacuuugacagaugcacucgcaucacacaaaauccccuuuccauaucauuauagcuugguuugaaacggggaauucaguggacauuggcuguccuaugaggccucuauuuuacccagauuggagaaaauauuccgguucugucaccugagugugacaaagugcggcuguagggcagagccauaccugggucacagaccauuucacuccaaaggccguuuuccucacuggcuuucuaaguauggggagccugggagugccucaaccucagggugugggagccuuuugucccucagacauccuuuggagacuccuacaggagaaggaaggcgccucugugacaggaaucaggaagugacuuccaguucgcuccgcaggacacuuagaggcgggguggguaagagaucaaaauguggguggugucacagacaacugagggcccagcucaccagagcuuaggguuccguuagcuuuggauuuguccuccacuaguggagaagccgacuugaaaaggccaccgaguagaguuaggcauggagaaaaaaaguacucagugucauaaaaaccuacaucugcuaacagaacuaaaccuggggucaggggugaugaagagaaaccuucccauuguguugguuuggcuuacaaaguuuacccgcagcacccaaaagccuuccuucuuagcaggaagaaauuuugcaagaugccaggcaacuauuuccauugaucucuaacacagacacuucucucagaaaccaaccucccaacacccucacuggagaaggcacugcuuaguccagcccaguggaggucugacuuuguagaugugguauucugagacucucacagacgguaaggacagacgcucuugucucucuaucugcuaggcugcaaucacauuacacagauacccccaggaaacagcagucuuugcaagacucugucagaacauucuagaaaagcgugacucuugacugugagugaggcucuguaacaugcagaguugucuucccgucugccacuacuuaggauagcaagcaagaaaaaaaaaaaaaccuaguacaaagaaggucuaggcggaaucaugcgaugauuaacuguccccgggaagucucuccacccuuaucauggcucaucauaaucccccacaauggggccaccuaagggagaaguguugacagacagggcaggcugacagacaagacagaccuccccagcuggaaaucuacccuuuccacaucaacugagugucccccuagagcaggcccccccucccaccccagcucaaccucaacagaaagaaaugaaauuaugagaugaagacgcuccagaaauaaacuauuuguaaguccccaguaaccucugauggcuaauuguuacaauuguuucuaugguauuguuucuauugugacucuuugucuaaucuacggauuugauuguaggaauguauucaagaagaaaaaaaaccaaaccaaaccaaaccaaaccaaaccaaaccaaaccaaaccaaaccaaaccaagguacacacaaggaugggcacugcguaugguuucaggaaugcccugggagcuugaaacuuauucccuaaggauaaaagagggccaguguaauuugagacugaaaauaaaaaagacccacuacugaucucacacauucaaagccguaacguguaccuauaaaacaaauuguaacccuccugcguggucucccuucaaagccuacucauacuuaacucugcauuccuccaccggaaauggccaaagucagaaauagagacagcugugaaaaagacagaucuguuccaaaacccguuuuccuucucaguccacagcccgaggaagaacgugggcuuguguuuuucaggucagggcugauauuaacucuucauaaacugggcauucuaacuugaccuugacuacacaggagggaacuuuuuacagaugggccaugauuaaaaaaaaaaaaaaaagacuaagagacagcuaugcuuagagacuagaaucauucuuggccauugucucuuagcgcacauuaucacuggccuguagaauuguuaaacgugacagccaccuuuccccuuuucuccugcuuugucuggcgcgccuggagccugggguaccugggccagguuggguucugacgcucucuguacagcauggagacgucaggucugcacugguuugguaauauccagggaggaagcagaaacaucugagguuauuuuuacuucugcagguccucuggcuguacaggguggaucaaguauugucuggagcccuuuaggacucuuuuuuuuuuuuuuuuuuuuuuuuuuuugcauggccucauuuccgucuuccuguugcuaggaaagggaguuaggcaugagaaacuuguguuuacaauacuggcccauccugugcagaacaaggcucucuucaaaagagucccauuuaguucacucacuguacucuggaugcccccagcucuucuggaccaaaccacccucccuugaauauuuccaaauugaguauuuacucgguuaggucauaaaaauaccccucucauuuaaacauugcaucaugcuuuuaagaucuccacagggacacccaggaaaacccaaguacuaauuuuuguauuugaagccaccucuuggagccuccucaccgagccucagauuggaaguaucuugcaugagucuccucuuuccccuuuaagccccacaucgcuucuaccaauaggagcuggaguaccagacagcuuagaagccacuugauuuaguaauagcuugcugcggucauaacacaucuauuggccuguucuauuggucuuuguucuuuuaaccacaauaaggccgaagggcaaacugucuugcauguauuccacaauuaaagaaaacuccuuggguugcuucagcauacugaaaucugaaaugguuuaccauccucuucacucuuuggaaaguggugagcauuagagcuaccaaaaaaaaaauaaauaaauaaaauaaauaaauaaauaaauaaauaggggaacuuagaauacaagugacugagagcagccuucauccacucuagggcaaagaccuaagcuggagaccacaugucuagauugcaggcucuaugacuuggggaaaagucagcgccuuauuccugggcuuuuggugucauuuggcucagaagaaaguaaaggcaauuugucaaaagcaaacucugagggaaaaagaagaaaacccagcuugagagaaagucugucugccuugcuucgcuugaaacucucugaacaguaguacuaaugaaaaaauuaugcacccaggcuagggcuuugcugcaagucuggcacgccucaauaaaagugaacacaggcgaucuccaacauuuucucaggaaaugucuugaaauaacuucugacggcacaucugcuaaccauuugacacucaguccuuccucaggacuuuggcucuucuguuaggggggcugcugccucgcagggcaccccucugaccaucugcugcaaucugcuugccaagauggcaccggguaguccauuaauuccacccuuauggucagcaaauuaucccgcagaggacuagccugcaguccagauggaagcagaauuagucaaccucuuagagccgcugauagguuuacauuuugaggggcugcaguccacugggcuauuauuuccccucaucccuucagaaaacagauuucugcaggguuaaaaaaaaauguaacuugagacugggcauucugccuucuccagagccugauuuuuuuuuccccuacucaaaugcgucacauaugccacccccacgaaucuuuugguaauggauggcccgugccuaggcugcauuccuccgaaucaccaagccacagcuugaaaccaccucucgccucuagagaaugagcccauuggugaccacauuggguguaaaaagccucauugaaagcaaaaccggauggggagauauauuuuucuucccccucuacugcgcugauuaaugacuuaggcaggguuucucuuuuaguuauuggcauaauuugcgaacagagugaacuucaguauccgucacccgcuagguacuuuaccuauuugaugcucacaacuuccacuugugucaaaaguuacuacucaggguuggggacagcacagugaggaugugccacuuccccagggucgcgcaucaagagggaugcuggucccgaguucauuuccccaaccucaguccucgcaccagaggccaugcgcugaaaugacucgcagagacagaaaaccacaccaacagggugggcuauugcucuagaagcaacccuuaagaaggaucaaaggcucucagcuacugacguuggaggaggggacaggggcgcaggguggggaauuaguccaagacgccgucgccgcucaaaaaaaaaaaaaaaaaaaaaaaaagccacaggccuggagucuugcuuccuuccuuuccccagcccacggacucuuucucccucgccaagggcgugggcaucuggugggguuuuucaggaaccgcguccaaccacacagcgggaaagcgcuggguuccuagcuggaaccccacgugcaacggggguuguggguagcuaaggagcaaccccuacuuagcccgcccaggcucagagauccccggcguuuaaaaaaaaaaaaaaaaacaggcgaacgcaacaaaagaacagagcucuuaaauagugcuaaggaaacauuuuuucccgaaguacagcuuaaagucuacacagccccuuaaauaaugcacucuuagggagaagacaaagcugauuugagacuuguaggguggcaagaagagauggaacagucuccaaaagaaguccaaaagggguugcucgccccucggggcccgaggccagaaggaauaguaugagucuaagucacccggacgccaguccccaguccccaggcaauacauggucaagggacaugacccgguguuaaacucuccaacaaacccugacccaagcugcuuaagcacacacguucuacuaacgaaagccuggggcuccuccucugcaagcgugucaaaacacacaaucacaacacggacuuggcagggcagcgugacaaguccuccucacccggauccccucagcaguugaccccagccagacuaguccaacaacaaggcacaaguccaucuuacguguuaggaucaugguguccggcucgucucuacacauuaaggucggcgcagggcggcgggagcgcacugggaacgucgaggcugccagaaguaaucgggaucccacgucgggacccacgguggcagccgggacgcgagccucucgcggucgucagcacauccugguucgcagcuuccuuacgcuucgccccagcucgggcaaaaucguggguuuuagauugccaccgcgaagggagcgcucucagggagcggggcacggagcuggggagccguggcuccaacagcgaggacgcacagccauggcucaggcuggagc

SEQ ID NO: 12415 - RNA, 18270 nt, Mus musculus
uguauuuuuauugauauaaaauguaccuuaagacuuguuaucuuuggacuuuaaugaaauugauuuguguaguuaacaaaucaagaacaucauaaauauguuuauaaaauaaaacaguaaggguaaaagugauggaguaaaaggaagccgaucaagggaggcggugcugucauaaaacuggagcuccaacaucuuaauggccagccuucuggcagagaggagauagccaaucacagggcuucuuccugaaggguguaaagcugguuugaaauucuucagucacauagcagccuaugcaugccaauuagaaaccaacagacaugagaugugcuuggaaggcuaaacacuacacacagaaacaguaguuacuaggcucuucaguaguuccuugucuuuuucuguuauuccuguugaacaauuugcacaaugcacgugcuguacucugaaugucaaaaacaagcaaauacuguaaaaaggugguagaugguuauuuuucuagcuaagagcaagaaaaaucacaauuucugauaaaauagaggauugaaaucacucucuaaagugcaaacuugaugguccacaaucuuaaauaccuauaaguacugcagaauagaaggagaggcauggaagagggaaauaaauuacacucaaugcuaguuaauuuaggaaaagggaaaaacaaaaccaagcucaaguaggcaaaguuuaucaaauuauucaguaauguagcuuugucacacaagcuugauaagaaguguauuaaauuaaggccagauuuaaccugaauguacuuuaauuuauuaagaucauagcuaagaaaggccauacuuauuacugaaagcagagaaggucuacaaaaggggggggguauugccuauuauuuaagggaugauaaaaccuauauacaagcauguguguaacucguauaaaauaaaaauaagaagacuauuuccugucaugacugcuugcuggcuuccucuucauaugcauucccugugccguucuguacauaggaugagccagaaccaaggccauauaagugaccacaguauuuggcaucaucaaugugaucuucaaagaacaucuaaaaagaaaauuuugaaagaaaaaaaaaucaucuuaagcaaaugauacaaccuguaguuuacaucucaacacuguaauugcuacuaacucuuucugugauguuccuuugagaagcuaugcugcauauuuaauaaauaagacugacugaugcccuuaacuacaggccuaaaggacacguucuaaaaagcaaaaauauuuuucguuaacauuuaccucauuuuaauaagaacuuaugagcauaaaaaacauggcagacauuuucauuucuuuaacauaacaaacuucacagaauaugagaaguaaugucgagaaggggaggagacauuauaccaucuuagguugucuuaagucuaggugcaagggugaacugacuaaaauuaacaaaauccuaagcaugguauagacaguaaaccuuaacacucucacuacaucacuguccuugaagaagacaauaaaaaggaaaauaaggauaacaaacuggugccagaauuccaccacugacuagccauaagacauuuuaaaauaaaaauccagcuaggcagugguggugcacgccuuuaaucccagcacucaggaggcagaggcagguggauuucugaguucgaggccagccuggucuacaaacugaguuccaggacagccaagacuaaacagagaaacccugucucaaaaaaacuaaaaaaaaaaaaaaaauccaaaaggugguccuauacugaaacuaaguuaguuacgugaguggacaauucaaauaacuucugaaucaauacuaccuggcaaaacaagucaaaugcguucugucaauagcauguuuuuaccaagagaauauacucaaaauaauuccacagcaacuauuucauaaaaauguguuucuguaggcacauuuuauauauauauuuguaccauuuauaccaaacuaaaauaggacacacacacacaguguaccaaaaauagaauacauguguguguguguguguguguauauauguguguguguguguguguguguguggguauacaauuaaaauuuguuuauuauuaucagcaaugaaguaaccacgacaucuaucaccuaguuaucuauccuaaaaacacucaguuccacuacauaucauccuucuacuccuaacaauuuuauacuugaauuccugauaguuuugacucaacuauaugucagacuucagauuuaauuaauaccuauauauucaaaaagccuuuaagacuuaguaaaaacuguuaaguucuacuuuauaaaaccuuuaaagcaaugaagaaugacaugagcaaaucuauuuucgccaccaguuucuagaaaaagaagguacgacucccuggcucguauggggucuaagaaaguugaguucccucacuauuaccuuuuuagcuuaaaaaacagcauguucauauguacaugaucucuacaaucaccuaauuuuuuauucuauaaacaacauauuucaguagaauaaauaauguuuuuuuauucuauaaagaguuuauucuauuuccuuuugcguuacauuucaggaggacuuauuuaacauuuucauucaaaugugguggauguaacuuauauaguaccucuauuuauaucuucacuuaguagguucuuaaugcccaaaacuuuugucaucagaccuuuaauguucucuaccuaacaaccaagaaaaaggcacugaugucuucauacuucucucauuuugaaaaaggccauuccuguaagcagugagucagauccugccuggugcugagggccuaugcgcuccagcucuaacugcucagcaacuuccuguaauccacccuagaaggaagaaaaguugcuugucaaauagagaggacuuugggacuggaauucacaauuacagauuuagacacugacaaaaauaugaauacauuuuuaauauguaaagaugaaccuuguaaagauggcaaggggauugauaaaauaugaaucuguaauuuaucuguggacuauaaaagccuuuuuuuaccagaauaugaaauucuaauaggaaaauuuuauuuuaauuauacaucuuaaggcaaguuaagcaugccuuaacaacuuuccagagauaugaaggaaguagaucauauucaggguaacaguaauaaaccauacucagugucauuaaaaauaucugcauccccuaaaguauuuaaaacuuaguaaaacaaagacaacaugaguguucagaccacugucauugucaaucuaccacauaauuuccauuuucucaacuaaaaagagaauuuuacaaauauacaacucuuuuagaaugguugcucugaucugcuuauauuacuauagcuaugacugagaaaaauaacgagugucaaaggaaaagagaagaaauagacagacacagaacagacuaccaaucaacuuccuccuuaaaauacaaagccuuuacuauccuguagucacauccuagccugacaggacuccugccagcaacgguuucuaacauugugugcaccaugcauccuuggcagcugcuuagaacacagcagcagacuagauaugaaugacugguagcaccuuauugcuaacauacacuuuuaaugugagcagcucacauagcacucaauaaaauauuugauauuuuuagauauuucugaauauauagaagaauaaaaaauuaggacucuguuucugaaaacuaucauuauaccaagcugucaauuaaaaaaacaaaauacagccgggcaugguggcgcacgccuuuaaucccagcacucaggaggcagaggcaggcggauuucugaguucgaggccagccuggucuacaaaguaaguuccaggacagccagggcuauacagagaaacccugucuugaaaaaccaaaaauaaauaaauaaauaaaagaaacccugucuugaaaaaccaaaaauaaauaaauaaauaaccaaaacaaaacaaaacaaaacaaaaccaaaaacuuccagagccagccaggugggagccuuagauucucagcaugccacucaucaguguaaguagucagaauacucugcuggaguucacuuaugaggaaaccucaaaugacacaggauucugugacuuucaacugacagucaugagauaaucuuucaagaaguucuccuaguuauuuggcaccacaccuacaacagugacaaauuacuucuguccuacaauucucaguaaauuguugaaacuaaagcuuccacauuauaauuccucuauucuugcuuaagaaaaacuauuaaauuccuuacuguuuccuaaagcaaagcucugucuguauuuuucuaaaaccuagauagggaaaacuuggccaaccuugguuuuacugaagacagggacaauauuggcuacacauacacuuguuuccuuaguuauaacuuaacauaucacaccaaaauccagcaacuaaaaacccacucaguguauugccagggaucugugccaacucaggggaauuugcucuugagccaaaguaguacuuuucuuuaaucaggaaauguuuguuuugauaaaauuaauguccaaagguuaaaaauacauggcuacauauguucaguauuaucagaauaagcuacugucuauauagaaccuacacauuuacuauauaguauuuaugccuaaccaguuuuagcuacgaaaauaacaacaucauacuuuaacaagaaagaauaaaggagagucucuagucaggauaaucugaaggaaaaccaccuuagaacacuacugagugucucugcccccugcuggccaaccccaaucuguaugcuugugauaguucugugugcugggaguaugagaaccucuguaauacagggcucugucaguguacaccucacacuuucauuucaguugaugacccucaaucuggcaucaauaacaaaaacauggcccuuagcuuggcuuuuguuaaaaauuuauucuggggacuaaagaguuggcucagcagcuaagagcacagcuguuguggaggaccaaauuucaguuucuagcacccacuagguggcucacaaguacccauaacuccaguuccagagggucugacacucucucuuuuagccucugcuaccucuugcuguaaacuuccacagaagugagugagaguguguguaucuuaaauauauauauauuuuuaaaagauuuauuuuauuauuauauguaaguacacuguagcugucuucagacacaccagaagagggagucagaucuuauuacggaugguugugagccaccaugugguugcugggauuugaacucuggaccuucggaagagcagucgggugcucuuacccacugagccaucucaccagcccucuuaaauauauuuaaugcaauuaauauaucaacauuauucugggcuggaaaaauggcucagcagguaagauaacuugguuggaaagauagcucagcagguaagagcacuugcuguuuuugcagaggacacaggcucagccccaacacagcauggugguucacaaccauccauaacuauaaucuaggagaugggaugcccucuucuaaccuccucagacagcaggcacacauuuagugcauauacacaugcaaguaaaauacccacauacauaaaauacaauuuaaaguaucuacaacaagacaaaaauccaaccaaggaaaacacaaaaccaaaacaaaccuuauccuguuaagauaaauaccgcagcuuugaagagagauuguuuauuaagaauaggaucagauaauuuaacuaacuuuuuucuuuuuuuuggagacaggguuuuucuguguagcccuggcuguccuggaacuuauucuguagaccgggccagccuugaacucagaaaucugacugccucugccuccuaagugcugggauuaaaggcaugcaccaccacugcccggcuuaacauaacuucuaaaacaugguuuaaaacauucaggccuaagauauuauagaaauuacuuggucuaaauugugcuucucaaccuuccuaaugcugcauccuuuaauacagcuuuguuguggugaaccccaaccauaaaacuauuuuuaucgcuucuuaacuaugauuuuucuguuaugaaucauaauauaaauauuuguguuuuccaauggucauaauugaucccugugaaaggguuguucaacuuccagguugagacucauugggcuaacuaaugugcuaguuccggauaaagucaucugaagccuuacuuugagauuuuugcagcucuucaugagguacuucacaucauaaaugacaggaaaaaauaaccgaaggaucucaaagaaaucaaguucuuccucaggcaaguuagaguuggucagaauuuugauuaaauagccaaagucauaaccacuaauaaaaagauuaaaauaauucagaaaaaaauacauuaauaccauacaaugaaagaaauuaguuuuucagauagaaaguuaaacaagucauacuauaggcaaaaggauuaacaauaacguacacacaggaacaaugaaaagaaacacguccauaacuacagugcagaaacugaucacucagcaucuugaacacaugauaguauaaauuuaacucuacagucacuaaaauaacauuuuucugauauguaagcuggagagaugauguucaaacaugaguauuuuugacccccaauacccaaguaaaagcugaguguuuuaugucaaccacacagacaugcaagugcacaccccaaaagauagguucaguaaggucacugccacagugaaugggaagguaugugaaaauguaauaaaccagcaagacuuaacaugccaaaggcaaaaaucauguaaaaccuugucaccauuuacaugagauggugacacuuuccaauuucgaagaauaaaucccuaacagaguauuucauuuccacuaagugacuuaauuaagauguacauuuccucaaauguuucuaugucaguauaacucuccgagacaguugucaauggaaaaguuaaaugugacaggaacuaaggaaaaguaagaacugguuuuuuauacaauacaacccccugcucccucaaacugacgucacacauccuuuaucacgagucuucccacagcggccuaacuccuuccccuccugaaguccuccugugaagggccugugccagccuucccugaagcccaaccccagacaucuccguacaacaagcguuugcuggugcugaccuuuagguucaugaguuuccuccacuggguuaaaggagaggaauuauagcuauaaaguaucuuuuucuuaccuauaauuuaaacucauuauuuggcaaaugaccuuacugagccuaucuuuuggaggacaaacaaaaucaacuuuuauuugauguuuauuauuuuacuuguaauuugaaggaggagaaguuuuaccauagaagaucuuugguacacgcacccaagagcagguaugugugguuuugguuuuguuaaaagauccacagcacuguucucagugagguacuagacagacucacggcagcuaauuccuucuagagcuaagcacaacacugcugacacaguaacccagacagacguaaaaggcagaugggacagaagcacacugcaaccccuuauuuauuuauuuauuuauuuauuuauuuauuuauuuauuuauuuauuuauuuauuuauuuauuuauuuauuuauuuuuuaccugugaaaugauagccauuugaccccuucacaaagaaccacuccugaagucauaagaaguucugcaaaauauugggucucaauuccuuccuccucguguuuuuuaaacuggauaccagauguuguuaguagcucuauagaguccugagcauacauguccucccuggcaggagaaagaaaacgaaaguucaaaauucccauuaaacaguuguucuccacuuaugccuacaacuacaaugcagaaacaagacagaggauugguuuauguccaaccauucaaaugcuucacaaugaucaagaaaaauaaaauaugagguauccaaaaaguaaauaaucauucaaaaaguccaauggugaguucacccuuaacaccaacucaauuucaucagcuucuaaacauuacauacauuucacugggcuuaaaaagggucuuuuacucaccagaggcuaccacagacauguucuuuucagucucugcagcuauuuuagugcugccagauggagcuguaaccacagccaugagggguuaugcacaccucucaugcucucagcagaaccaggaaggagacaccaaguggccaacaucucuuguggcugaguuaaacuacauuccaucuuaaagaaaaaggagaugccuccucucacaaaugaggagccuuucagcggcucuaguuaagcagugaacuguucagauaaagacucaguuaugacaucauuucuucuucagcaaucacauaccuacauuagaggcaaauacaauccuagacgacuaccuuaaaccaagccaggaagcacacuauaaaccagcucuucaaacuuuuacuuaaaccacacaaaaagccaccuauaguuucuaagcacaaauacauuaaguauuauauuaaaaaguugaagauucaugaaaaaguaucuuguggauuuaucacuuauuuuuauuuacuuuuuaaaaaaccuuaacauugguuucuaccaucagcaaaagaaaauuucuauaaaagacuucaauaaaacuaacaaaaccaaaauuaauguuugauuuucaucagauguauuuuuguagcuuauucucuggaaaucaauuucaaaggucaguuuaguucccagacugucaggaacuaaaugacaaaauuaagaauugaagcaucuaaaaacagagaggagccacagucaucacuuucaaacaucaugcuuucucuugaaacauccuguaggaaagauaucagaauaaauucaaugcaggcccucccacuacccucgguuaaauuguuuguuauacuaaaaauaugucccuuaaaugagguccuugggcucacacugaagcucguuuaaacacgauuaaucaaucaagaauacaguagacuguucuccaggcucauguugcucuuagccacaugcucaaguuauuuuauuauagucaacauuauguaaccauuaccaaauuaaauaauacaucaauaagguaggauagugagucuuggugcauuuaagucauuauuucccaaacuugcccaaugauaauaaucaccaggggaacuuaccaaaaauauggauucccaggucccaaugcagucccagaccuauugaaucacaauucccaggugagagaccuggaggaggaccucgguauuuuauaauaaaguaagguuggcaaacaaagacacaugaacacucccuuucuuucucucucuucugcaaaauuuauauaacucagucuaagcuuuguagaaugagucuuuuauaguaaaguuugguacagaacucauacuuuauaauacccaacucauaaccuuaauggugaggucaaucucuagagaggaugaaggaaacuuccuacaguaagguaaauuugauagcaauuaggagucucauuuccaaaucacuguacaauccuuuucugaugguaccaacuuuagauguucuacauucugcuuucucuacucucaaacauucuagcaauaaagggaaaaauacuaaaacuaacauuaaaaaguaacuauaacauuguuuagucaaacuguaagaauuucaucugguguuggcuacugccuguuacaucuauuauucagauuuaaguuagcaaaguauauaguuaugacuaaacaugaguaaaaaacauguaaaaaucuccgaagauuuuccaaaaggcauagguacauacggcuaucuuaguuaauauccuaaagaugcacuaucuacuaacucaaucauguaaaaauaccaaauuuccuauuuuuauaauaugaauaaacccuauuauaagaacucacacuucuaaacguguucuuaucaacauuaaacuacuucuugaucaccucccagaugcccaccauagggucgauauagcaccuccuucaaaugucacuuacuuuuauacuaaugguuagccaucuuuaguuuuuaauaaauuaaauuaauaacaauagaccuuaauaaacucaaauaacagcucaaaauaaaguaauaacacaaaaauauaucuaaaauugcaaaguccaugaaugacaagaagacaacuaaaaauaggaaguauucucacaaguccaaauagcaagcuauuuaaaauagacuaauuauuuauucuuuugauggaugaaacugggcagaaguuuccaauuugcaaaagacuauaacuuucagaaaacaguagcaagccggccugcuuguuucuuaauaugcacauaugugcccaguuaaaacuuacugaaauauuccuucugggaaugaauacauaaaauuuaacaagguuuucaucuuuggauuuagauuucaacuuccaauaaauuaaccacaaaguuuccgaagaauauacagauacuccaugaucaagguuauaaccugauaaccucauuagaaguuaggacgacaguaacaaaaggugaaaauauuacuacaucaccuaaaugcuuggcagcagaguguaaugcaagcuaucauagagaagagcagccagcugggagacagugcuuccuacugcuacccaacacuguacaagaguauacagugcugccaaagaaauggcacaaaauucaaaauuuaaugucucauccacugaaugcauacuacuucuguauauagucaaaaaguguaaguugagccaucaugagucaggagccaugugaagggcucacuaaagaaccuaaagcauagacccuaaucauccaaccacagcauaguuagauauaccacaguacauuaagaaaaagguccacuuagguggcagacaggcagaucucugagcucgagaccacccuggucuacaaagcaaguucaagacaaccagggcuaugcaaaauaaaacaaaaaacaaacaaacaacaaaaaaaaccaaaacaaaaccccacaaaaaaaaaccagaaaaaggucaaauaacggauuacucagaacucugaauaacaauaucaccaauaucacauauaaaugagaaauccuuaauauauaccaaaaauauaauaguuacacaacaacuaggaggaaguguugagaaacuaguaaaaguuguuucaacuuuucaauacuaaugcaguuucaaaagcaugcuuuuuguaaaaaagaaaaaaaaugucagcaaauaugcuuuauaaagucacaguguaacacuguuacagucaaguuuucuuucuuuaugucugaaauguauauacuucaauguuaacaguaauccuguggguaaauccacaccucgcaaguguguuuaccucaccuuuaaccugaggagcuaaugagaaggugagaaaacacuacuagaaaaugcuguccaucaagccaacaguuuuaggcuaugucaguggugaggauaauccagcuugcucacuccauaacacucaaguuuagcucugaagaggacacaauagcagccagugugcucguuaacuauggcugugauguucuuuuucuguuacagaguuuaucaagcacugggcaaagaaagcaaagucuuagcuugaaaacacacauuaauaaccaugcuugcuuucaagcccacaguaaguacaacaguuacagugaccaaaauaccaauaugucuaaagacacauuuuuacauagagaguauuuauuuuuuccuaaauguuuguuaccuaauacugaucuagguauuacaagucaugccuucaagauucagagaauguuaaguaagacuugaagagcguucuuccaauuguagguauuucuuauaagugggcuacucucaagaaucuaugcaaagcuuaaugcaacacacacugcaacuauacauaucuuuccacaaaucuuucuauuuacaccugauaaauaaugcuuugcacuuacucccuugaugcuaaugguaaaacuugaaacaacacuggcaaaccuaaaagaacccugacuuggacaaaugugagaauuaaacacaaaaauuuucgcaagcacagacaacaggcagagagaugaaaaccacuaggcuauuaugauguuggacaauguucaccaacacugugcugcagagccuagugcacuaacacgcuccuucuaggcauucaacaaggucaauuuccaccauccuucaacacgucuaagaugcuauuaugaugcuucccacauuaugcaguacuacuuuuaucuucucaaaggcuuuuguucucauuaacauuuuucacuauguucuuaaaaauuuuagccuaaaauuuucauugugugugugcgcgcgcgcgccugcacauguccaucauaugacacauauucaguucucucccaccaugugaguccugagcaucauacuuaagaucauccaccaugauggcaggcacuuaagcacugagccaccucaccagccaaugcacucuuuucuuuaccauccuaugauguuaccauuaguagaaauaguagcaaaauuggcgguaaaacuaguuuugucugaguaagaaaaaaacaaauguuccuggagaauaauggaaaagccacugcuacaaaaauuaccauccuugcaaugaagacuaccagcuuuaccaacuaauacccugagauauuagcucccagucacaaacugaguaucuuauauaaaaaaacaaaacaaaaacaaaaaaaccaaacaacacccaaugcuaugaugauuaauuugagggguaaaaagaacccugaagaaguuaaaauaggaaaaaacuaaagaacacaguaaucauuugaggagagcaugggaggacauuuucaccuguuccaaagcuguaguacucaugaagcacuaugaaaugacaguggggaugagcacguuagccuuucuagggucuauagggacugucaggacaguacuagauguuaaaauacuaucaggauuauuuagaggaguaacaacacauuuuucaagauacacaacugcaucgcuuacacuacugccuucuaaaaccaucaguccugcuauucauuaggucuaacauaaaacuguacauauucaacaaaaaauaggaaugaagaaagaauucucauucucauguaagaauucuuacacuagcacugauuuucuuaucauuuucuguugcuauuuuucaaaccagauguuugaucauauuauacaaauauaggcuaccaagcagaagggcaccacaauauuguaacauaguacagaauauacuauauauuuuauuuccauaccugaacagcaguaauaugccccugccucauacuaggcgcuuauauccugaagcucagaagucauaugaacuccacaaugguuauaaauguggcaaacuuacuuaaaacauuguguguguguguguauauauaaauuuuaaaaauccaaaugcaugguucuugagcauaaacuuugccaaugaugcugugucaaaaggauggacucaccuucaugcaguucccucagcuaugaagauuguaauaauuaauguagaacuauuuuaacuaaagaaauaguuuauacccaagauuugagguagacaucagguuuugguaaauaugcaagcuucaauacuauuacauuuucuguauguagauuaagagguugaggauugcauuggaauagcccuuuagagaaaaugaauuugaaaagaaaauagccccaauuucccaagaaauaucuuaguacacguggugaguauuuagaaugcaaaguaugacuguaauaauaguuucuucacaggaauaauaacuaucuuaacaagucacaguagauuggaguuguagcuaagugguacccgcuugcuuagucagcaaagcgccaccccaaucauauguauuccaaguugggcauaaaaacaaaugugaaagcucuaugugugguggcacaagccuuuuaaucccagcacuugggaggcagaagcagauggaucucugggaguuugagcccagcauugucuacauagagaguuccaggccagccuaggcuauguaaugagacacugucucaaaaaagcaaaacaacagcaaaauguaaaagucaaaucaauacccuaagggucaugcuuagggccccagguuuaaucugcagcaccuuaaacaaugacaaacacaacagaaacagcaacacaaauacagguucacaacuuuccauaaaaaugaccaucauauuuuaaaaauaacaucucuauaacuaaagucuuugaaauuagaaaguuuuuauuaucuuucuaacugugaagcaauuacaacugccucguaauaauaagccuaaacuuuugaauuucuguauuuaguacauuuccagggacacugagguuauauauuuacuucccacuuacgucaaauuaaacuuaaaguuaaacugccaaguugacguuccuggaggguauucucccuguucauucauaaaggucaguccgagcuggauuaucuuuaacaagucuacauuacaccgcaacaguugguacugauagucagcauugcuucugaauucuccaaugggucuugcaacaacgccuggaaacucgguguccuguaaaauaauugauaauuguuuacuaaauggucauaaauacaacccauaaacucucaggaaauuuuugauacaagucagagaauucuaugacaaugaaauucuguauguucacacucaaugcuuauuuuauaagcaugaacagcauuaccuaucagaccucaauauucuauaaacuuaaauuacuuuuucuugaaauuuauccauaaauuacuauccuguacugauaacucauaauaaacucaggcaaauauuugggcuauuuccaaggaaaagaaaaaucauaaacugauuccuaaggaguaggcauaugaaacuacacuuauagcauuacauuacuaaacucaacccgcaugaaagauugauuuaaaaguuaaaaaguacccugugcuuuccaaucaaagcagugagacaccaaaauaaagaaaaagucucauuaaugucauuucuuuaguuagcacagguguuuucuguguacagucacacucucucuuguaagcuguccuuucuguaaugcagcuauuccuuauuaucugagauauaaaugaccacuaacaauuucugcugcucauaaaaauaacggucccugccgagacagaaaguuucagcucuaauuauggacaagcauaccuuacugaaugguaugcuauacaaagaaauuccuguuuauccacagagaugcauuucuuuuuaaauugugauaguaaaauuauguauuaguuuagcaugagcauucaaauuaaggcuaacaaaaaagaggaggaggaggaagaggaagaaaaaaauaguaagucaauaugacagcaaagaaauuaaaauuugcugaauuuaauacaaccaccagccaauuacuggauucuauaaaaauuaagcuagacgugaagugggccagggauagaggugcaagacauugaaauaucgccuucuagggcuaauaauuguguggaucaagaaaauagacuagcacugggcgugguggcgcacugucucgagaaaaacccugucucaagagaaacccugucucgaaaaaaaacaaacaaaaaaacccaagaaaauagacuagcuauaacaaauacacaaaauguaguaacaaagcagaaaauuaauuauacaaacaugcuaggcagacugaauaccacuuauaagagcagacuguuuaaugaucaaguauguuucuggagcuuuagcaauuuuuuuuuuucuaaaagaucuacuuugguuuuucuaucuuucuucuuuuuaaaaagauacccaggaacucacuggucugaaagcuuauuuggaccuaguagcacggccuugggauugcuuagagcugagcugacaugcuuagauaggcuuuauaguccucccacugaacguaaucagcuucacaaaauuguacaucaacaaguacauucuguaaccauguccuccuccccaugccaaagacgucuaaaccacacaacauucuccuccuagcugagugagcgacuccucccaucugcagccuugguaucuuacucuugccuucucacaaagcagcucagacucaguaaaaacccauaggaaugccauagcuuccugagagcacagggaagccugccucccuuaaucucuuaaacccaggugaagcaagacuaaauccuaaagcaugucugccacuuacacucaaaugucccugacuccuaaucccuugccgauuaaugcaagcaguaaaaacucaacuugucaaaauaguuuuguuucugauagccuucgaugaaagaaauaguccacuuuuuucaugauuaaauuaauccuuagcuaucaaugagaaggguuuaacugaugguuuuugguuuuuguuuugguuuuuugagacaggguuucucuguauagcccuggcuguccuggaacucacucuguagaccaggcuggccucgaacucagaaauccaccugccucagccucccaggugcugggauuaaaggcgugcaccaccacgcccagcuuuaccugaugguuuuaacagcccacuccagggcuuagggggacaguucaucugguaaaagcacuuggcaugcaagcauguggaccagaaggaguucaaacucaagaaucuaugcuuaaaaggugcauggcccaugugcuggcaauuuacauguuuggaaagcagaggcagguggaucccuggggcuuccuggccagucaauguagcuuaaucaggaagucucaggccaccaaaagacccgugucagugcaccccuccccccaaacacacacacacacacacacacacacacacacacacacacacacacacacacacacguacuuauucacucacacacuucccacuucacccuuacaaaaggcauuuuaaaaagcuuuagucauguccauaccauagcaacauaauuauauuuucggauaacuugacggauuuucuucaucucuucauccagguuacaagcccaaacuucacaaauucuuuggcuaugaucuacgguugcugcuggcauagugacagcacaaggagucuagauguggagcaucaaaauguuauacuugauugaagauuugugucauaaaaauacuuuacccuuuacuuaugcaccuguugaaauaaaaaaacaccaauaucaugaaugugaauuauaaaacugggcugguauaaaccuuauuuauacaaaguucaugacucauaacaaaaucaaguuuuagacaguuccuuuucucaagguauacagcuaauauuuagaggauaaaagcaccacaccgccgauuucccaacugaauauaaauuucacuaauuaagauuugcuccgaguucaauucacuccacacaaaacuuugaaccauuucaagccaaaaaaaaaaaaaaaaaucaacaaaaucaaacguuucauaacagaaugcuugcuuuuauucuucuaacaaaacauuuaaaaaucuuacucauucaaagcagagcagaggaaacauuuuucuuaaaaauguuuugaaaagccauuaggcaaucucagaaacaaauauagcgggagggagaaagaaagaaagaaagaaagaaagcaagcaagcagguaggcaggcaggcaaugaaauguguacauuuaaaaauuucuaauuucaaaaacuggcaacccaagagagaccucacgucucugccauccacacaagguucacgguauacaaugguaagauaauuaaucagacggacagggaccaaacacacaauaacccccgacaaaaccagcgaguuaaaagaggguggccuggugucccaaacuccuaaauguacgcuggagaaaacaaaaggugaugcagggcacgccuucuuucuuccuccccuccguccucacaccggucccuacacgcgcucuaccgacacacuguacuuuaacccugcuuuccuccacccgcucuucucuacugcggucucaggggucccuccaaggggcagccaaggccuucucaucccugaggucgcgcguccuccgugggcgagcaacguggagagagcacggccgccuucaugucaaggauaagucgcucggcuggccgccggccaggagcagggugccuauucgcauggccuagagccagaccgacuacccccaaaaaccacugccgaggacgaaagccaccggggccccaaguaggccaccgcccuccacucgcaauuuccuucccac

SEQ ID NO: 12416 - RNA, 64539 nt, Mus musculus
uuauaaaaucuugcucauuuaauagaaacgauugauacaaaguuguugacauguuuucucaguauaaaaaguagaaacauggcugagucaaaauacauacuuuaguuaggaaaguuuauacuucuauuaauagacuagugacuuccuuuuaauucggaugucugucugacccacuggcagggguugguccuuggccuccuauaaagcaccuggaagcugugugugcagaugggcaucccauugguccacuacucuucacuuuccaaaucaggaaaacucaacaguggucgcuacuguggucuguccucggagauucugagcugugcauauguaguagcccgcaucaauggucucaaagucuuccacgauaaugacacucugggagauucuuguggugugucccaguccucugugaaucagucuccagguguccuggauggucacaggccuuucguccugguuaaagauggcacacagacuaaagucacauugacagcugcuucccucacucaguucccauccaccaggcccauucaguacaagcucacagaaggcugguugguaugcugagcucacaagcggaggguuuuuguuuuugauugcauaauuacucaaggcugccuuucccuuccuccacuccucccccaaguggggucuugaauuucaggaugcuguuuuugugauuucuuuuugcuuuuuuuauauguaaaaugaauuauuuugggccucuaugggggaccagcauaaacauaucuauaugagcagcaucuuuucccauugugucacccucacacugccaagugguucuuguuuauggaacuuaaggucaaaagcacugacucuguaagugaagaagaggcaggaaagcaauuaggcuaauguuccuugagacuacagagggaggccaguuguaccaaggaaggcuaagauaaugcccuaggcagcaugagcaucuauucuagaggacggugacuuguaagaucuauuucaggcaguugcagcaacgagaacaguguuuucuaaauucaauugauaagggugauuauaguaucacuuaaugcuuuuucuccuaauaacagcaauauaaagggucacucuauggaaaagcaagaaugucuaaguagaacaauguauuuaaaacaaccaaccuaacaucuagaugcuggaaagcucugcccuccugggauccuuauuuuccaccccucacaggcuaagcagagcacaggcuaccuagagugucuugggagugucuccucuggcaaccaaguugguagcagagcuguuuauuucagugagcagaccgugcacacagacuggggacuucuuuuauagaagacuauuuuuaaaugaaugaugcugaccucauaucaccuugugaacagggucuauguuucaaugccccccuuggagaaugucugcuccaaagcuuugugcaggcguuguguggggcuccauggccugcaggugcccgccuuucucccacuggugucuuugaaacuuugugcacugugaaagguuagagcagucuagaguggaccuagauggugauguugaaagcugaaguucagauguaaguagccuugccccgcuuccugcugcaaucccuaaggaggaacaaugaacacaccacauacaaaggccucuugagugauugccugauacagccauccacucuuuuuccuccucuuucuuuaaagcaagguauuuugaaguggacugaaauaucuuagaagacaaacguucccugguuccugucuuaucauaaaccuaguagggucucucuaagcgagagagcuagcugagugaggcuccaguguggcacuuaccuucugcccaggaaagagccaccugaauucaaccuccacaucaggcuccccgaggacagugcagagcacgcugaugucaucaccgccccucacuuuguuagaggaggccaagaugguuguugauggagggccacuaggaacugggaacaagcaggagacagaaaugagauccauaacugaugguaaagacaaagaugguacguucucucuggggagaggaaaccuuuucuauagcuucaugaggccaaugcuagacaucccuuuugauugccuuaggacagugguucucauccuucccaaugcuaugaccccuuacuacaguuccucauacuguggugacuucuaaccaaaaaauaauuuuuguugcuaccucauaacuaauuuuguggcuguuacaaaccauaauuuauauuuucuuucuuuugguuuuucgagacaggguuucucuuuauagcccuggcuguccuggaacucacuuuguagaccaggcuggccucgaacucagaaaucugccugccuccgccugccgagugcuggaauuaaaggcaugugccaccacacccggcuauuuuuucuuuuuuuauuggauauuuuauuuauuuacauuucaaauguuuuccccuuuccugauuaguccccaauccccuaucccaucuccccucccccugcuucuaugagggugcucccucaccuaccccacccacccccucccaccucccugcccucacauuccucuaugcuggagcaucgaaccuucacagaaucaagggccuccccucccacugaugccugacaaggucauaacauuuuggaaacaagucuuuauuauggccagaccacucaauggguaauuuugauggcggccuucagcaaggagaugugcuaagaacugggacuagaggagcaagccagacagauggauugagcucuuacagcccacagucuagcagagugugcagccccugagugggcaacuguaaugcuucauuugaacuuggaagaagcccagagugagccucaagguaacauagacugagaaucaggcaaggagcuaaaaauugaagucucagcacuaagcuuaagagacacagauuccugagcagucugaguuaaugggaggugacucggaggaguggacgaggccagagcaguggugccagccacacgaggccuggcaagaacuuuguguuucuguagguaagaacauagcuggauguauugauuagaacagcagucagcaacccugcagaacaugguuucgaaaaugaggugggcagaugggaggaagguauucuugguagcaguagccagagauggugauagcuugaguaauuagaucaggaauuagaaauggaucugaaacuuaauagaacgaaguuugaaggguuggauuucuggugacugaugagcaacuaucccugagguagaggacauaggucaaccaugccuucagggcaauacugaguuuacugacgggcaugggacuggggccauugagguccccuggagcaucugaguacagauacuaccuggacccaugguucuuaccucacagaccugggccacagaugcacaaguaggaaauuauuaguucacagcuauggauagaaauaagcauuuccacaaagagauaagaugcccuccuucuuuaugccuuaaguauuuccgcauuuagaaucuaaagaaaugccagaguggggauuuuuuguuugguuuuguuuguuuguuuuuguuguuguuguuuguuuguuuccaugaggcuccagguucaagccccaguucugcucccaagacaaaacaauggaagugcaaaguggggcuggauggauuagcaguuaagaccacucacuccaugcucuucuagaggacuccgcuuugauucccagggcccaaaccacuccugucccaagugauccguugcccccuucuggccccuuugagaacugcacacauuugaucucuagacacauacacacaggcaaaacauccuuacguauaaaaucuuccuauuuuuucauauuauuaacaaucuguuaauaaaauuuaaaagaacuggaaaucaaaaggagccaaggugaagggauuucacuugagaaguggagucuaauaggaaggugacaugugcuaaucugcuggaugacacuggacuccugaggucucuggcauuuuauaauguacagagggaauagcuaaucacacggggaugaagggaaggaaagaugagucagggaauacgaggguuuucaggguauuuggcuguggugaagaaagacaugaccucuguggagaguugggggcugucaaguagaaguauuagaauuagaauauuagaaauccgggucuaccaaauaaguccucagcagagaaugaaaggaauuacugaacccauagucugucuuuaaaggaggugcgagacacaccucuguccacaggaaagcaccuugccagugcaagaguucucaggagacacaaagguuauacuggagggccuucaauuucagggaagacuguaggguacacucuccaggaacucacaggagggaagaagggagggaggcaggcucaggagaaucuugucaaaaaggggaaguaguaugugguucuguagaaagaucugcucauuagccaaucccuuugucaucaaccuagggcagaaaagccuuggaacaguugugagaguggugggcuacaaagaggagagcccgugguuagaaccccagggagcaagggaugugaccuacagccaaccaguguuuaucaacauguucaaguugagaguagaacggaggcggcugaugaauaggccaauggguucagggagauacugaagucaucuugagaauauaauggcaagaaagacaacuaucaaaugauggcagggagugacaggaaaugagaaagccugcagaaucacagccagcauaguggaggaacagagguuccuaauggagggugacaaaacucagggugccgggacuagggauggcacauccaggauaccagccccaugguggaaagugaugcuaugccaaucaaacacaggcagaagagaagaauguggagugggggauacagauguuagaccaucccgugguuggggguugaagguagacucacccucuacauagagcagcugauacuugacugagaucugagacuugcccccggcuuccgcuuugcaguagaccacacccuggugaucggaaugaggcugaagguacacgaaaccucucuucaugucguacacaauguccgugccauuggcagggauuucuuuggcgggaaacucccuguggagcgugacuuuggcugacggggcugucacucgacaaggaaccacagcuugucuguccggguucagguagacaacaucaaaguaacugggagaaggcacaaacagcucuccuuucucugcaaaggagaagacacaggcuuaaugacuagaaaaaaaaaaugaagcaaggcugucuugaugauucuuaaaaccagcacacuggaucucuaagagaaggcuggcuuuaaauaaaaaguaggggauuguuuugcauccuuuaauuuagcuauaauuuagcugcugacuggccccuagagguucgugaauuaaaggcuuggcuauuggaaguuauuccgguuuggugggagggcuguaggucaguagauaugugcucuugaaaguacuuguaggauacuagccuucuuuucucucucccuaauuccugacaauagcacuugucucaacccaggacuaaagacaugaggucaaucgaucauggacaugaaccucuaaaacuuuccucuuaggaagcuaguucucuuuuaucauagcuuugggaggguaacuuacccacuuccccuaucuccuuaaaggaaaaaccauaaggauguuauuucaacuuccaugcgucacacugaagcaacagaagaagacagcuuuccuuaaguuaaaaguaaaaauaaaaaaauuuagaagaguuugugugugugugugugugugugugugugugugccuguggaagacagaagaaaauguuggauucccccuggagcuacaguuaccagcaguggugagccacuuaauucagguccuauaaaagaacagcaaauguucuucccugcggagccaucuuuccagccucaagagaaacugucauaagaccuugaacuguccugugcuucuguguagagaaugauccuuauagccaagagccagaaacugcuguucagaaggguauaucuuauauaguccagguccucaggaagggucaccauaaugacaucacuguccucacacccaacacagaagauagaguauaugcuaaggcuaauggaagggggaugggauagagacagagggaaaccugcuggucucagggauggcuucugcuuggcucuaccauguaguguaguuggggacuuucaccuaauaucaggcaggcaggcaggcaggcaggcaggcagacacacacacacucacacacacacacacacacacacacccuucugcaguguagccugucagauuuuaaacccuagaugacauuccugucucacagaacagaaacaggugagaacugucuuacaacauccccaggacagcaaaaggauuuggaguuggauuuuggggcacauguuuauguuguuuguuuaguuuggugugacacauuaaguccuuuuguuuucuggauuguucuguaaagggauauuauaguaauugcugagagaauucucuggggcuaaucacagaacacuuguuaaauuguuucuuguguuucccuuucaguguucugaagcaagcaauuauucuuggcuuucucucucucaccagccucccauguugccauuguaugauaauuccgguuggccauaggaauccuggaaacaacaucaaaaguccucaaaggcaggaguucuuugguuccaaggaccaaguucaggaacacagaaguguuuaaaggucaacauugcuaagcccuauacuagccaaacaaggugauuaugugacuuugcaaauugacuuucuaccagugacuuucucguguguccaaaaucccuguugagacagagaaaaucuauguagucuugaguguguuacucucucugugcuuuaaaaccuccauuuguugcagcagagacuaaagaaagggccaucugggacagccccaccuggggauccauccugucugcagauaccaaauccugacacuguugcuauugcugagaggcacuugcugacaggaaccuuguuuggcuguucacugggagguucugccagcaccugaccaaugcagaugcggguguuugguuccaaccaucaaacugagcucagggacccugguggggagcugguggaaggacuagaggaguggaggugauugcaaccccauagggaaaacaauguaggcugguuggaccaccuagugcucccagggacuagacuaccaaccaaggaguguaccuggagggauccauggcuccagauaccuauguagcagaggauggccuugccugacagcaaagggaggggaggcccuugguccugugaagguuugaugccccagcauugggggaugcaggagcaguggggcaggagugggugggugcauaggugagugagagagcauccucauagaggcaaagaggaggggggagaggguggauuuaggaugggggguuuuggagagguaauaggggaggggauaucauuugagauguaaauggauggaaugauuaauaaaaaacaaaacaaaaaaugaagaaauaauaaaauaaaacuuccauuugugaagaguaaauaauauuaaagccaugucuuuugaguggcugagagugugacucugugauagggcacuugccugggaugucgaaggccuacguucagucccuaccucggcaagaaaauaaagauuaaaucaaaaaaggaaggaaggaaggaaggaaggaaggaaggaaggaaggaaggaaggaaggaaggaaggaagaaaccaaaacagaauucugauuguaagauuguagaggcgacuuugguugugagguuuggugagugacuuaucugccccacuuagcaaagccaguagacucagagaucagcuugaauuucagaauacaaaaauaaucuuguuuccuacuguacaaugcaugcugugggggaaaagugaaucuauaucaguugccuuaaaaauauuuggagcgcugggcaugguggcgugcacaccuuuacucccagcacuugggagacagaggcggguggauuucugaguuugaggccagccuggucuacagagugaguuccaggacagccagggcuacacagagaaaccccgucucgaaaaaaaaccaaaaaaccaaaaaaacaaaaaacaaaaacaaaacaaaaaaaauuauauauauaguuggagagcaggaguauggcucaaugguagagaacucucuuaacauguguaacaugugaaaggucuagguucaauguucaguauuacacacacacacacacacacacacacacacacacacacaaacacacacacacuucucucaccccucucucuuucccugucguccccccucucuaacucccaccguaacaguaacuuccaucuuuaaaaagaaauguguuaagguuccuuuaaaaaaaaaguuauagguuccacacccccgacaaauaugcuaguauauauucacauauccuauugcuuuaaaacuaacauguggaguuuuauccuuuuaaacgucaacgcuaauagccuauaaaguaaaguacaaaucgcagcacacugggugucuaguaaaguacuuaugaaucuggucuccccacauaugaaaaccauugccucaguauuucccauggagaaggaccucccauuggaaucgugguccuccuugaucugucuguguggugguuacacauggcugcuccuuugagggcaauuuauugagcuacacuuagggucugaagcuuuuguuuacguauguucuaccucaguguugagagggguugggggauggggugaaagaacaugaaacugucucccggguaagaagacauaaauguggcagucacuaaucaagcauuacagauuaacaacaggcagcacccaaaaagaaaaauaggcagcguuuuguuuuuuuuuuuucgucaaacucuaggaaacacacaaacauaacacucgacagacgcuuccccgcguggguagcugagaaccauauguucugacgggauccugagcccgcggcggaaccucagcuucucuggcagcccauccuguuuucugaaaaccaagcacacuccaaaagaccaagugccaaauccuguacugaaagccuaccugaacuuacgguguguugaguaaaagaacaucaaaauaguaucaccucugcgucugucugucugucugcucccucucuuauucuuucucuuuuccuuucuuccgcccccccccuuucuuuuuugacagguucuuauguaagccaaggcugguccuugaacucacuguguaguagcuaaggaugaugcuaaacuucugcucuuccauuuuuccuccugugagcugggauaaaaggcaugugccaccauaccuggcuuuauaccaugcugggguagaaaagaacccaggccuuugugcaugcugggcaaacacucuaccagcugagcuauauccccaaccuagucuucugaacaauuggagugggugcuauccccaaagcuguuggcuguauguggaauauguugcucuagcugggcuaccuugucugggcucagugggagaggaugggcccagccuagcagagacuugauuugccaggaggaggggauacucagagggaaauuugagaagaaugggaggggguauagggagaauaauugugggaggagggcaaugagugggauguaaaguaaauaaguauuaaauaaauaauaaaaauaaauauaagggcuggcaagauagcucagcggguaagagcacugacugcucuuccgaagguccugaguucaaaucccagcaaccacaugguggcucacaaccaccuguaaugagaccugaugcccucuucugguguguuugaagacagcuacaguauacuuuuuuuuuuuauacuauaaaguauguuuuauuuuauuuucacuuuaaaacagauucuucucucaucaaauacacccaaaccacuguuuuucuuuuauucacuucuuccauuuacccaguucuuccacugcccagauccaguucccuuccuuuucuuugcaaacaagagcaggcugccaagaaacaacaaccaaaccugacaaaaucaaucaaucaaucaaucaaucaaucaaucaaucaaucaaucaauaagacacagcaagaucaggcaaaugccccuauaucaaagcaggacaaggcaacuucaauaggugggaaagagucccaagaucagguaaaagacucagagucaaauuguucccacucuuguggguaccacaaauccaucaagcuaacagccauaaaaauguaugcagaggaccuggugcagacccaugcagguucugaguuugccacuucaguuucugugagcuccuaugagcccugcuuaguugauucaguggaccauguuauugugauguccucuauuuccucuuacuccugcaauguuucuuucccuucuucuucaggauuccaugagguccaaggaagggguagagaccuuauagagaccuccaauguagacugucucugccuagugucuggguugggucuauguaccuguucccaugaggccagaggaagccucuuugaugaugacuggacaaagcacugaucuaugaguauagcagaaaaucacugggaaucauuucauugauuuuacuuuuuuauuuuacuuuauuuuauuuuugcccaguuguguuugauucuaccuaggucucuaguuucucguccugcaugcaugggucacaaguuaaaccagucauaguuuggccacugccacuaguucggcuccaccauugcuuuaacacauucuagacagauuauaggucaaggguuugggggcucauuugguguccaaauuucccuuuucauugucugcagaguaccuuucuguaccagagagacuaggauguuggggugaaggcuccaugcagguaccagcucuaccucuauauacaaugagcuaaguugaaguugcucuucaaaauggagacccacuguuaguuuucagugagucuccguccuaguaucucaccacugaaagcuucgccuggcuauauaagauggccaguucagacuccauauccucgauuacuaggaauucucacuagguucacacucacagauuccaggaaguuuccacugcacuagguguucacacuaacacccucauuucuagcugucucucccucccuucccuuccccaccaucugaucucuccugcuccaguacucgccagcaccaacucuaccugaagaaucuuuuuuuuuuccauuuuuuauuagguauuuagcucauuuacauuuccaaugcuauaccaaaagucccccauacccacccacccccacuccccugcccacccacucccccuuuuuggcccugguguuccccuguacuggggcauauaaaguuugcaaguccaaugggccucucuuuccagugauggccgacuaggccaucuuuugauacauaugcagcuagagucaagcuacaguauacuuauguauaauaauaaauaaaucuuugggcuggagugagcagggacugagcgagcagggucugagugagcagaguugaccagagcaagcguggcugagcagagccagcaggguugaccagagcgagcagaggucuuaaaacucaauucccaacaaccacaugaaggcucacaaccaucuguacaguuacagugaacucauauacauuaaauaaauaaaucuuuuaaauaaauaaauauaaauaaaauucauuuugccucaacaaaaagaagaaauguuuccucaauguugacaucgacauguuuuaacccuccuuugauccacuuugggaagugaagaagaggagucaccgacaaaacucacagagcacccaugaaugcuaaccuaucagccuaucagcccguaacagcuccagugacguggugccaugcuuugggaagacacuauagugcuaagcuagggaaggagucuucagccugcaguuugaauaugaaaucugccuuuaucuagaauaacaagcucuuauucaucuuaaucguuugccuuuucuuuacacuuugccauaugucauaacacaaagggcacacagauaauucuguguagcauauccugagcugaaaaucuuucaggacuucccaugaaagcccauuagaaauucucacacaguuucaauugcacuagcgagugccucucucuccacccaucgguucaucgacuauguuguccuaggaaggucucaaggcauacuagauagcacuggauugugggucagaaaaaugagugugacuccuuuauaugcuacuacgcgccccagaucacuggaagagucaucuugccuuuuuaagccucagcauccauauugcuacuaaaacaaagauaaugaaccagcauuaacuccuuuccuugggacaucacaggaggggaacgagaugacugcacuggagaaucggcccugcuacuguaucuucuugccauggaggggcuauuugagcaggaaggguaagcuauaugagcuguugcuaaugcaccaguuaauggcugagggauaagauugcugggucauagauguaguucaguacagaccugccaggcagaucaacucaggacuuagacaaaucucaugaaagccucugcccagauccuuaaaaaggguucugauuucuccugagacuaauagcaccaggagauagaguuuacaagaugccuaaaaguuguccuugaccuuugagccuugcugaagaaccuuaccccucaauguuggagcucucugagguccaagguggaagaaggaaggcuugggagggacucuccacugugaccacagguuuuucccuuccccuccuagucucaggcgagauagaagcuaugaggauuagagacuucaggaguccugcucgggaguaucacaagaacaaauaagauggagccuuuagggacccacuccgaugcuauggaggucccagcaggaacugggcucaggucugaguacaggaaugagcagccaacagccgcaccaugcaacuguagaacucaucauuccuaugcaguccacuaugagaauaugucaauuccacaugucauaacugagcacucaaagaaaugaauguuauauuucauuuuaacauguaauuguuaauuaauauauauguuauugauauugucauauuaaucacauauuugcauauaacugcauggugauaugcaguuguuaauaugcaauuacaauguauaaauacugcauauuaauuauauaauuaaaugcauauaaauugcauuuaauaugcaaucuaaguugcuacauguaucaaguggcugcccuauugagcaauauaggcauagacccugaaucagauaguccuguguucaaauccuuuuaccaucuaccugauaugggacuuugagaauuuucuuaauuuuucuaaaccucguuucauaucuggaaaaggaacuccggaaguaauauaucuuuuuauccugaaagacugucauaauaccuaccugaaauauuccacacauaaaagcacuuaggcaugagccugaacaauaaaggcguucccaccccacccccaccuuuaccugggguucuucgugcagugggaacccccguuuggagguaaccuuggcaguucguucauggaguucugcccugaaccaaacucauaccugugaagaagauauagguggagccuguuuuggcuucaucccgucugcagauguagccauugcacaguugcucccagcagcugaauucaccggugucggccgcgguggaguugaccagagucaacugcccauagcguucacucugcuucacacuguaauuucaagagagguugaggcaucaggacaggucagagccuagccaagggaccuucuagucacaugguuucugcuucguggcuuccuaaugucaauacccccgcugaucugaugugaccucuuaaauggcaaaaacagaaagaguguguuugguggguggaggaaauagagggggagggggcagaaagaaagccuuuuccuaaaaggaaaauaauaaaugacaauugucuuuuccauuagaaacucuuuggccucagagcugggguuucuagaaguaagaccauuggggggucuuagcaugcagccuuaccaauuuggccaaaaaagccugggacugaugcuugcuuuuuaaaagaaaggggcucagagcacaacaacguggagagagcacacugaauuagugaagcuccaagguuaaacuuagaaucuuagagauacuguacuauuaugugaaaaauggaccccguuuucucugcuaagaugugagcuccaggcauugggguacacccuugaaguacucauggccauuggcauuucuggcuuuugcuuuggucucauccuauuuuguuuuuauuuuucccgugcuuuuaucuagcugacugguaagagggucuagaaaucccccaauuucucccugaaaugaagacauuauuauugacuaguaauaucagcaaacuguccugauaacugcaucaucacaaaaacccagaagaauggucuuccuaacggauguugcccuguggucaggagucccagcacgcaauaccaaaauaaacggguuuaauccaagcgcucaugucagacaucugagcucuucagcgcucugggcuccacauaacuuucagauggaguggaaggccucuuuuucaucuugccaucagaucauuaugagcacaacuuuaaauuuagcacauacaaaacgucugcgugugggguccugagcacagcccuucucuugcucccugcuggguggcuuauugcccccacugggccugccaagaggaggcugcccacucccacccuucaccucucuccuuuaaacuggacggaaaucucuccucccucaggaagcuucuaauuacaauggccucaggcaucuccccccacuuucuccuaaugaaguaguuggccccuuguuuuccugccccucugacaccccuggcuuccuguuaugacacuggauccugucagggaaagggacuaugccacauuuguuucauauucucagagggggaaaaaucugugcauauuacgcaguauggauuccugaaauacaaaugaauuaaaacugaagcaacaacaacaaccugaagcaacaccccaaccaauggacagaagcagcugacccuugugguugaauuagggaaaagcuaaaagaagcugaggagaagaguggcccuguaggaggaccagcagucucuucuggaccccugagaucucucaaacacuggacugccagacaacauacaccagcugauaugaggcccccaacacauauacaguagaggacuuccugcucugugugcauucagagauaaugcacguaacacucaagagacuggagaccccagggaauuuagaggucagguggggugggggguagggacauccacauggagacagggggugaggaggggguaugggauguggaacaguuggaggguggauggagaggggaauaaaauauggaguguaaaaacaaaaaacugaagcaacacacaacacuaugaaucaugucaaaaagcaggcccucagcucccuauucugcagacaguuuaaauacaggaugccaaucacuaccccaugauaccccagcuuaugagaucuagaggggaugguguuaccucuaagcaggaaggccuagugggaacucucuuuucugguuacuggugccuaaagagagugagaccuucacccccuuucucugccauuuuuaugacuuccuuggaggaaaauggcucugccccacaguguacugccaccaggauauaucacuaugacuaccaugauacgucaccaugagaccaaagcuaugaagucaaacagccaugagcucaaaguuagaaagcuggaagucaaaauaaugacccuauucuucccuuucauguuguuagaguaacaaauucaacagcagauuagaacacaggggcucagaaaggugaugucccggagacacacagcuggugacccacuaaacaagaccccgugaguuaguuguguccugagcauguacuuagacaauaaaaugaugcauauaaagcauuccaugcaaugccuuguuggcugcuuuuucccaauuauuucuaaucacacauaauuguuagguucagacuagcuauugugaacgcugccaccacagcaacaacgaacaauacacacccagcacuggagaguguuagcacugcaaauaaaaaacaguggaaauaaggaaaccgcauuaugcuucaagaguuaaaacuaacaaccacggaaagacccaggaacaaauaaccagguucucacaauaaaaauggaauucucaaaggguggggugaagaggccgaaggcagccuugaagaggaggcgagacaaucggggcuugaauggcaagaggaggggcugcaggggccugagagagagagagagagagagagagagagagaguggucagugugcagcagggaacugugcuccacgccagggaggcggaggauguacucugcugaagucacugugucuacccgaguagguggugcauggaaagaauauaacaaugucuuagagauuucauccauuguuugcagaaggagagagaagcaggguguggggagucacaggcacaugcauggagaacagugaccauggucaucuaguaagcagugggacacaaccuucacucuguggagugggaagccacgggaccaccaucgucaggacacgggcagacagaagcagaaugggagagguggaaagaaaagagagacucugagacuuugcugcuguuuccacagugaggucgugccuaggcauggcuacuggaggaugugaagaucccggagagagagaggaagggauuugauaagagcagcaggaggagauggucucaggaauggccucacaacuucaaacucugugguggaagggauagaaaaaccugugacugaaacaaaucgaggaagauagccuagauuaaccucuggucccuguacgcacacacacacacacacacacacacacacacacacacacggaacagaaacaggacucaccauggaggcccgaagagaaaguuucaugaauagaugcucaagagggucagaugccuuuaagagagacugugaagcauaaacacacaauuucauuugacagugugaaacucuugggcagccaucagaagaugaauuucaggggcuggugagaugguuuagugauuaguacacguuucucucucagaagacccacuuuuaguucucagcccugacacagcagcucacugcuaucuguacucuagauacaggguauauaauccccucuucugaugucugcaggcaccaggcacacauacaugcagguaaaaacacauguacacauaagauaagaaaaucuuagaagaagggggaggaagagcaaggaagaagaggaggagaagggaggaagaggaggaagaggaagggggaggaagaggaaggggaagaaagaggaggagaaggaggagaggaggaggaggagaaggagaagaaggaggaggaggaggaggaggaggaggaggaagaagaagaagaagaagaagaagaagaagaagaagaagaagaagaagaagaagaagaagaagaagaagaagaaaacaaaaaagaagaagaugacgacaacaggggagagggaaaugguuaauuucagagguuaaaaaaaaugucaaaagaaaauggagguugagguuuucucuggagaccucgccacaugacaucuggacacaugagcucuacagagcucagaaccggcuaaacuaccaaggaccucucugggcccagcauuuguuugcauggaaguggcagaaaggguaagaggucauuuccacuagggagcuaagcaggcacauaaaagcuaagacuggaggauaaucuagccaccgccacgguaaucgcaugcuguaucuuuagcagacugggggcggaaggaaggaaaugcccuggaaaacauuucugcauauuuccacccccucuucuacgcaaaccucaucaaacaggaaacaaauuauuucaaaggauuacaguuuaaaugccuggauuuaaaauguccaucucuaccaguggucuugcauagucuaagcaucgggcugcccagagaguagggucuggggggugcugagcauaugucaugacauggugaaagacacaaacugaguucuguagaacuaucuaaguggagaugcuucaaccuaaggcucuucuuuucucuuauaaccacugaacaacucugguggaacaggaagaagggagggguaggaggugggaguuaaaaacaauugucacaaccaaaguagcaugaaaaggugggacaggaacaccaggaugaaccuggcuauaacagcucugagcauccuaacacacuagcuuguuacauuagcuuauuucaguuuuguuuuguuucuuucaaucugacacuucugaccugggaguaauggaaaaggccaggagucaaggaguucuaguucaggguucaaaauguuuugagggagcguucauucaaugcuugugacccucuucccaugagugugugugugugugugugugugugugugugugugugugugugugcgugugugugcgcgugcguguuucugcuccuguuaguggaggucugaaacuuucugcauuugaucuagcuuacucucuuuuagagugaugauaccuaaagaaaggaacugauguguuccaaagauaagcaccagaauguccccaaaauaggaaccucuuacuugaggcagugaccagguaacaauggugaguccuuuccucuacaagucauaggcaggguauaagcugugguuuauaagauaauuguucaucgguuccguaaguacuuaugacuauaaacuaacuugaagacacuagagugaagacaauucagagauucuagaaaauuccuucacccaacuucuguauagaauagaguuuagaggaggguagccagaaaaaaaccuccaggccugaggggaucuuaggagcagggaaggaugcuaaccaguccaagcagggacugggagcaaggcauucaaaggagauguccugagaggauaagacaaggaagguaagugcccaccaugagcugcagagccacacggacaagguucaagucccugacccagagugacuuuaggacuucagagcucgaguucuccucuuccacauccuguguaccugaccccugcagaucugucgugagaacagucaguaacugacccuuauggcacacugggugugacaccauacuguucagaugagucacagaccgugcagccucaggucggaggacaacccguacaguuuuagaccggaucauuaucccgagucccugugcuccuuauaauccuuacagucacauuagcaugaaggugcuaauauuuccuuuuacugacaugaacccugaaagguggaaaaccagccccuccgaagcccuccagccggcucuucuggccuaaccuagugucugccacacggacuugaucauaaucguucauaaguaaauggcauagguuucauccuaccaaaccaagacaaacugaugcaaaucugacugagaaacagugccucuaaauguggcuacccaacuccacaaccccggcacacaaacacacacacacacacacacacacacacacacacacacacacacacacacacacacacacacggcaaaaaaaaaaaccuugcaugaucucaugaagucagcuuauuaguagaaaucaagugaagagacacaaggcaccuugugcuacggaaagccauacuaaaccaucuaguaacuacuggaaggcaaccaacccuaggaaagcuaucaguuauuaagcaucuacuacauaaaugauagcacagaaagcacaugcuaccauuuuucuaaaccaugauuccagguacucugucaaauccucuaccuccccugccuugguucucauggggccccaugagcaaacacuauugcuauccuguguuguaggcaagcagcccaaggccagaaugguuaggauacuaccugaacauuauccagaaagacauggagccucaggauaauuggaagcuccauuuaauucauucuucccagggucacucauccaucuaaacucagacuuccagucuuggacacuauuuuaagauggcauaaaaaucaaagaugcauuaaacauccgcauucaaccuucacaucaagaauuaauuggcugcuuucuaccacaugcaaggaauggugccaaguauucucggggauaaagacucaugugugccugcuagucugcauuucaacuguuugcagagggccuguguuuacucuuaagucucguuuaagaaugugucagaagagaacuacucugugauaugcugggaacgguuucguaugacagcauucaaauucuuggcgacagacagcuggggcaaacauguugaagcugucugccacaguuacacuuuuuuuuaaaggaagaaagaaguuauaugcaugaaaacucacagagaaccaaauauacaaacuaaggaaccucaaaguaaauauagcucguucuuuccuuccguccuuccuuucuuccuuccuuccuccuuuuuucuuucccucccuuccuuccuuccuuccuuccuuccuuccuuccuuccuuccuuccuuccuuccuuccuuuuuuccuuccuuccuuccuuccuuccuuccuuccuuccuuccuuccuuccuuccuuccuuccuuccuuccuuccuuccuuccuucuuccuuccucucucucucucucucucugucucucucucucucucuuucugacacaugguuuacuuuguauaguccuggccauucaggaacucucucuguagaccaggcuggccucagacgcacagaggucugccugcuucugccuccugagucuugggaucaaagguaugagcuaccacugucuggcuugucaaucuaguucuaucaucugaaaccagcuagaagagagcugguaaagugcuuggcuugcaagcucaagggcccaaguucaucccuagaacccauguuuacaaaacaaacaaacaaacaacaacaacaacaaaaauggcuguaagggcaggugguccagcaguggggaggaggaagcaggacagauggauuccugucagcuuuggugaggucuaagucaguaagagauucuuucuuagaaaaaucaagaugaagguggaugauucuugaagcccaccaccugagguagcccuguggcacacacacacacacacacacacacgucacucagacauacauucacccuuacauucacauucucucgcacacaggaaaucagguugaaauauuucaacuaugauccaucaucuacuccucuaucaucuuugaauccacauacuuuuuaauccacaugcauaaucacucacuagcuaccuguuacucauacagcuaccuauccacgcauccucuagcuccaugacuggguacuauccaauaaacaauuccaaacccuuucauguaacuacaguauuuagguuucaacaaugggcuauaguaaugugugugaaauguguuguugagcuuucugcuacaguaacuuaugccugagucuuucuguuacucagaaauggcaccacaggacaaugugcaugacgucucuccagcucugcagccugccugccugucugucugucugucuguccacccauccaucuguuugucuguccuucugucugucugucucucacacucacguucucuccacagcacugacuggccccugagccccguuucaguguuuucacccgccaccccgcuauccugcuuuaucaguguucucuaugccucucuauccagcauggccuucaucaacacaaaccaaaacaaggccuccuaggauaaugccuuaaagaugcauguagcuccccacugccuccaaaggaagaggguagcaacacuuccucuauaggaacaguguguggcugccuccaacuauacuaguccaaaaaaagggugcugaguucugagaaaguuagcuaaccauucugugauaucacccuguaacgcagaaagguauucaagguacuuaaguuaauuuaugagagugugugaacauuuacauacacauaaaaggaaacuuguaagauuccauacuauagaguuaacaguggguauuuggacuuccggcagucccuucaauuuguucuccauaguguuuaaguugauguuuauuucuuugagauagacucuccugugucccaggcugccugcccacugguuaugagccuaggaaugaccuugaauuuugaauccucuuaccucuccuucuugagugcuggcaucacagcacgggccacacaccucguuuuaugcaaugcuagggauggagcugggguuuuggguacagcaggaaacacucuuuccacugagugacaucucccagcuucuaaguucauaaaucauaugagcgugugcugauguauaauaagaaaaaccaccacaaaagcagacugaguuaaaccucacgaaaccacugagcagacacuuuauagagacacucgagcguguguacuuuaaauaucuggagguugaccucacgucaccuuuuuagaauauaaauuuccaacuggcaggaccagcaggaaucccuuuggaggcauaaaaaacccaggaugucauacaugcugguuacaaaaauaaugcccauuggagugcaaaaaguguucagcuuugaguuguuuucagucuuuguacuucccugaagcuuaacccagcccccugacccccaagcuucuuagguacugagccuuccagucucaccauguagacuaagcucauuagcauuuagauaaagcaggggggaaaaaaagcucuacuuauuauucuagaaagaauaguucugggagacagaagacaauggagcaagccucugccacccuugcuaggaaaacaagcugaggauaaguaguguguacagccacagugaguguauuauggcugagcuagaauagugaaugcagaagcuauggggcuuagguccauuuguguacaacaaagugagcucaccuuggaacagcggccccaccccaccccaagcuuucuuaaaaacaccucaaguaugcacucacacugaugccacuuugcugugaaucuccugagcuaacuagaaacaggacgguacagaaagcccauggaaguauugaaaauugggcuuaaaacccauuucuugacaauugguuuauuaauuaauacaaauuuauguguauaauaggcuucaugugcuuuggucacgcccaucucauguugcucuuccuugccccaccuccucucagaugcaucuccuacuuucaugucugucucuuucuuaaucuagaccccacacgugaguugagcugucucucaggcugguuuucuucacuucacaugauucuuuccuguuccaccuauuuuuuuuuucucaaauuacaacacagaaucuaucuuuauggccaaguuucauaaaacaugcuauugugugugaaaauaaacuguguuuaccagaauggaacuacccacucugggagccaagguuggcacacaguagaaaugacugugccuauucugccacuacucaaaauaggcaagcuguggagcagccaagcuuaucauccauccauagaugggugaaaccgacuuugcugacagcuguaaaguuaagccagcuucuuagccugcugugggucaaaccugcucacuuguaaaaugaggagucuaggcaagaugcuaaguccccagacugcauauuccugguccuccuacagaucagaaacccuucauccauggacucugucuuccucuagucagaaagggugaccgaggaaaaaaguucccugcagccccacacacucagauugccacucugaaauucugugucugggacgugucucaugucauuuaguucaggagcuguuucugguuggggcccauucugguuuucuucuccugugugugugugcguguggugugcaguguauauugugugugugguguguugcaccgugguguauguguguaauauggugugaugugguguguacauguguguaaaacuuaggagaguccuuauucauaggcuauuacacuccauuuggcuaaguaccuauuaaucucaaccugcaacacacuuguggggaucaccccuuguggucucucauauagauaauugcugucuucuguuucuuuacccaaaggccuaccugucagaugugcuacacuagaccaugucacgagucaccuagcagauaaauacaggagaguacacuuuuuuguaucaguuuuggucgcuaacacgggguuccagcccuugggucgccuugcuugucucagcuacugacuggcguucauaaagagcaucacugaacuuacagggagggcugagcuagugguggcauugaccuuuccaaaucaaacgagacaccaugauuucucuguguucuaauagaaggggaggcaguggggugaggcccuaggcagcaggauugacccacagggaagucaggauagugucuaacaggcgacaggaucuugaagccacauggcagggcaugcaagucaggaauccaggugaagugagucucugggcagaugaaggcacagagaaucuacagccagugcagggcagguggauggagcugacagagaagcugaguccagacaacagaggcaaagcucugacauucuggguuaauucccuuuuuguggcaugcuccuuugaacaguuacuuaccacaggacauacaauucuccauuuuauagcuuauccuuuauucccccuuuccagcuuucgucaucugacaaaccuucuaaaaaguuuuauuuagacuuuauauauugaaacucuuggcaaaaauguucauaccucaauaauaucaaguuuuauuuuugcaaauaaaaccccagaccucacccacauguagacauauugaucgaagcgggaucgcauuaggagaauaggcagagucgcucagugacacccuaaaccauuuccacugcacgacagucuccaaauugucaucugcaagaguuuuguccuauccuuagucugucugacuugccauauggacuugacuuugccagcauaacguucuuuuuauauuguaauaccgugcagcacaucuggggaaaaucacauaaagacuuuucauaacguucaagaaaugagaggauuuuuguuuaacauucuuuuaaaacaaaaguuagcggaaagcauuuccuccuuccuugaaaaguauguggagacacagggcggggcgcuggaucgcuggcucucacaguaccccagggcaguuagugugacgcguucagcacuguggugcuguggacugugcuaguucagccuucccuaaaugcagccaaauacccacagaaaucaacuuuuggugaggaaagguuuaguuuggcuggcgauuuaagguauuuuagucuauaauggcuugguggucccagugaagaacaucauuguggaauagagagagagagagagagaaacagagacagacagacagacagacagacagagaccaugcgaacauguguauacaugcacacaugcacgggugcgcacacacacacacacacacacacacacacacacacacacacacacguaaggagagacggacuggagagggaccagugucucaauaguccuuucaaagaaacguuucuaauggccuaacuuccuuucccuaggccccacuucuucuuuuuuauuuuuugguuuuagagcuguauuauggaaaugcaggggaaagagagaagguagaaaggaggaagagagagagagaagagagauaggagagaggaaagaagacaaagaaaaagggaagaggagagagaaguaagagaagagggaggugagaggacaaaggaauaagaggacgaggugugaggugcgggcugagcaccccuuuuuauggucuucacuguugcuagguaacuggggaggaguuuagccugaaggucagaagcuugccuaggcuccacuucuaaagauccaaaacaguaccauuggcuggacaccagcuuuugggucauacuccagacccagacuacagcgugggacaucuaguuugcaggagacugagauaggagacuaaagcccuuuucugaaaacaagacuugugacagacgggccaugucccuacacuuugccucuuugggauacaauagagugaauaaaaauagcuccgcuucacggagaggcuugcuacauagccaagcgcuuuccacacaugaccucauucuaugcugauaacucgagaggagacggauucugucauuacccucccccaccccggcccccaaaggaacauagcugugauuuuucugcaccauuaacaccgucagaacauccaguacacccagagaagacuuguaccccgccuucccacuugucuaucucuagggacaugugggggccugcucuggugccauagaauguccuaccuuuagggugcggugaguucuuuauuuuuaauuuccaggguggaaauuuacuuuaaaauagguaucagaggcuggcuccagcauauacuuuugauuucuugacacaccaaggacuuaauccagcaccuugcuauaaccaggcaagcacucuacuccugaguuccacgucccacccgugagaaugauuucagcuugcuauuguuccguuucugggacccaaggcaacuuccagagggggaaaggcuuuauuuuaacuuagggguuacagucuauuauugagagaagccagggcaggaaccugaagcagaaggcacggaagaacgcugcuugcuggaucucucaccagcuucgcugcuuucuuauacacccucccacgaccacuacuguccuaaggaugcuaccacucauaguaggguagggcuucuauuaaaaaucaagacacccuccucccgaaaugcacacggggcuauaaggcuuuccucucaggugacucuaaguggaugcuaacuaggacagcaacgugugcacggagcuaaccugcagccccacauaaggagaaagagaagccgaggccacgucauuuuuuauuuguucugccaagaaaauccaacuucgaaggaaaaugaguuugacuuugaaacaaguccgccuaacaaaaccaguuuccccauguauacugaguuguauacguaagcgcgguuaaaaaaugcuaccggugcuguucuggguguauuuuaccacaauucguuagcugggggaagaaagaugcucccuucucugcauaccgccagugggugcucacguuaugcagcucccccucucucaacagccaguucuuucuggucauaaauacucccucgcauuccuuucuuugaaaaugcccuucggaugaauuccuucccccguguaagcuggugagacgggccgcuuaggagacuggccugcagcccacugucugcaucgcugguccacccuccuuuguacagucuguggguggagugagcaguuacccggggcagccaaguggaaagacagauagaugccuucucuucuccuaaaagcuauuuauuguucugagaggaaccagccaucaaagagagcugugccccacccacuccuccgggcuuccaguucuugacugaaaaaaaaaaaaaaaguuaacacccuacaccacacaccacaggcacauccugaaagauaaugaaugcuugaacccugacuuuguuuuuaauuuuuacuguggagcgggucuagggaacggccaaaaacuugucuccucacuuugagggugcagagcucacaccucuccccuuucaucagagauuuauuuaacccuuuggcuaggccacacgguccaaauuucuuacuuuguuuucugccucagcagagugcuaagacuuccccuguuccccacaccugaagcgcgucgauguggauggcagagcugaagacgaggaauguuugcagaacggauggaaacagaccgacugauguaccacugggaauuuaucuuaugaucuggaccauuuuacuagaauguuucacuguggcacacucggguugggaagagacauuguggcuugauauucugcacuugcaauuugucugucugucugucugucugucuuuuguucccccccccccagauaguuuuucuggguaucccaggcugucauggaucagaccagccuccagcucagacaucuaccucccaaguuuugggauuaaaggcaugugccaccauuaccuggcuuuuuguuuuuauuuuuaagacaggaucucacuaugcccagaaaccaagcuggccuugaacucacagagccuugccugcuucugucucuccagugcugagacuaaaggcaagggccaagaauguguguguacacucacaauucaggaccucugcuugcucaggccccacucauccccgcccaaagauuuauuuauuauuauacaaguacacuguagcuguccacaauucauuguggaugguugugagccacugaguguuugcugggauuugaacucagaaccuuuggaagagcagucagugcucuuacccacugagccaucucaccagcccccuagcagaagcuuuuaaaaagcauuggaagcaggggagggugcagagagaucaggaacaugugguaaaugauaaaacacacugauuguuuuuucaaguacccccuccccgccccccuuuucuggucucaaagaagggggaugucuaugcaacuggaaaugguccaguguggaagugauuccccagucuaccucagcaccccacugaaacaguugcuguagccucugagggaccuugccugugcugcuuagccacaccuuccucaagugcaaucuuuuacugaagacaaucuuaacgccgguaaagccugccaccuaguggucauuaugauuaugacaugauauggaagugacccacuuauuagaagcuaucccaggaaggcaaauuauauuccacuuacuaguuuucaauuaaaaauuuguuauuguuguuguuauuauuauuauuauuuuggcuuuuugagacaggguuucugucuauaguccuggcuauccuggaacucacccuauagaccaggcuggcuucgaacucagaauuccaccugccucucugccucccaagugcuaggauuaacggcgugcgccacuacuguccggcuaguuuucacuuuuuuucccgagacagaguuucucuguauaucccugccuguccuggaaaucgcuccguagaccaggcuggccuugaacucagaaauucgccugccucugccucugccucccaagugcugggauuaaaggcgugggccaccacgcccggcuaguuuucaaucuuaaacuugaaaguagauguauuaauauagucuaucccaggcugcagcgaguauaucucuccugaaacuggcuuccccaggccaagagugacuuggaucuaaguuuauuccacgggaccuaucacagauggcggaggauggcaggggacccauccaaguucugcggcucagcucagcagcuccggucucugcgagucauuugcuucaugggagugguuacuagaugcuggaagagcgaggagaaagcaaagaauggucaguggguacgaaguuccaauaggcuggggaauuugguccuccuguguagugcuggcagggugaguguggugaauaauauuuuuggauauuuuacaauagguagaagagauccuucugaauguccucagcacaaagaaaugaaaauuguaugagguaaugaauauguuaaauagucuaauuugauuaauacacaguauguacauguauagaucauuccacugcaucuccacuaaaauacauaaucaccacgugucaaagaaaacaacaaggcuuaccgcuaacagcacuggcugccuugcagaggaucaggguucaauucucuguacccacguggcuguccacuccaguuccaaggagauuugcuaaccacccucuucuggccucuacaggcguaagaccggguugugcagaguauauaugaaggcaaaacuuccauacacaccaaauaaaggauaucaaaauaaagaagccaaguguuauaaacaacagaagccaaggaugguagcccauaccuguuauucucaguacuuaggacacugaggcaggauugccgugaagauagcuuggguuacaaagcaaggaccugucucgacuuucucuuccaaaagaacaagcauggggcguggggggagagaaggaaggggggaaccuuaagcaaaaacaguaaacuuuuuuuuuuucagcuugaaaguucagagauggggcugguucggaggaccuacuccacagccaugagcgcuagagcucagaucccagugcccagguaacaugccagggaauccugcaaaaccuauagcugccucuuucuagcuuuuguguggacacagacaagaacaaacgaguaaauaaauaaagucuuugcaaaaugaagaaauuaaagcucaaauagaccuuguucccaggucacgggucauaucgaucaugguaccuaacuuucgaccggcucucagccccuuucgacagcauugcuuguucucugacaaccugcauuugccaggagacacugugcuggguaccagggaacagcaggcuagagcucuucuccaucucugguaagagacaagaccuuugacuggaugcagaugugaaagaugcaaacauccaaggugauucccuccuucuggugauguaaaaacagggaagaaagaagcaggagaaaggggcauuaaggaacucuauggcuccaguuucucggaauggaguaaugaccucagcagcugaaagagaaggaaguuagcuguuuuaaggacaaaauaaauugggcuuugguggugaaugccuauaaucucagcacugggguggcuaaggcaagagaagccugcauccaaggucagccuggcuacauugcaagaucccgucgcaaaaaaaaaaaaaaaaaaaaaaaaagaaaaucucuccuacaaacacugauaaucuuuuaaaaguaaacuuauaguuagacaauguacacagauauauaaugcguuuuaaauacucucucacuaggucaggugguaucauauaagggauuuugaauauaucucuuaaugauucauuuuuaacauuuuacgcucuuuuacuaugcuuaauucccaaaggauauuuuguauguuuugaaacaauuuaguauucaacauuagguauaggauccucaauuauggauaguauuacauauucauuaaugauauuuuuaggguaugaaagguuauggauaugaaaguugaacacauuuuuuauguauuauuugauucucaaaauacucaauauuauuaacauguuugauguauacaaugcacucaaauaauaaaaauuuaagaaaaaaaauuuaaaaagugaaaaaaaaagagaaaaaccaugaauucucuagcgaccuguaaucaccauggucaggaggaugggagaugagcugucugccuuuccuucccuccuuuugcuacacauagugcacauauauagugcacacauauagcauacacaugcagugcacccacauagugcacacacacagugcacccaaggcucuaaguaucuuucaauguugugugagugggugugugacugugaacugacuucugagacuaugaagacaccgaagguauuuccugauuucugacaugaggcagagaaccguccuagaugcuaggaaucugaucagccaccaguggugacauuugccaugaaggggcucuuuuugaugagaggagauggauacaaacaucagacuacagaagaauuagucaauuagaugagcucucacacacugccaagaaagaggagcaaaugugcucagaucuacaucagcagauucgccuugccgaguucucuugcucauuguuauuagucuuugucauaauugcaggaaaugaacaccauggauauaaaucaacccaugggcuaaugaacaguuuucaaagcaagaaacacaaauggccaggaauuauuuuuuucaauguguucaacagcccuaguuaucagggaaaugcaaauuaaaacuacuuugagauaccgccucaugccaguuuaaauggcuaucaucaggaaaucugacaaauguuggugaggacauggggaaagaacucuuauucauuguuggugggagugcaaauuaauacagccauuguagaagucacgacaucgguagcagaugugcagcucagucuucaugugggucccggacaacuggaguggaggcuaucccagaaucuguugccuacaugugggauauguucuucuagcugggcugccuugucuguccucagugggagaggaagcgucuggccuugaagagacuugaagggaaaggguaaggggauacccaggagggguccaaccugcuuaguggagauggggaggggagaugggagaaggauugugggagggggugacugggagaggagcacugagggggauguaaagcgaauaaguuaaaagaauaauuaauuaaaaauaaauaagaucuguaugauaagaaauucaagucucugaagaaagaaaucggagaagaucucagaauguggaaagaucucccauagauuggcaggauuuuuuuuaauuuugauuuuuuuuuucuuuuuuccggagcugaggaccgaacccagggccuugggcuugcuaggcaagcacuuuaccacugagcuaaauccccaaccccuaaguuuguuuuuuuuuuuuuuuucuuuuuuccuugauuuuuuuuuuuuuguuuuuuauuuuugguuuuuugagacaggguuucucuguauagcccuggcuguccuggaacucacuuuguagaccaggcuggccucaaacucagaaauccgccugccucugccuccugagugcugggauuaaaggcaugcgccaccacgcccagcgauuggcaagauuaauauaguaaaaauggcuaucuugccgaaagcaaucuacacauucaaugcaauccccauuaaaauuccaauucaauucuucacagaguuagaaaggacaauuugaaauucaucuggaauaacaaaaaaccuaggauagcaaaaacuauucucaacaacaaaagaaccucugguggaaucaccaugccugaccucaagcuguacuacagaucaauugugauaaaaacaaaaacaacauacaagccccuuccgcuccacucgagccccgggcuaccuugccaguggagucgcccgacacccgcaagggcccacacaggauuccccacgggauccuaagaccucuggugaguggaacacagcgccugccccaauccaaucgcguggaaccugagacugcgguacauagggaagcagacuacccgggccugaccuggggcacaagccccuuccgcuccacucgagccccgggcuaccuugccaggaaaguugccugacacccgcaagggcccacacaggauuccacacgggauccuaagaccucuagugaguggaacacaacuucugccaggaguccgguucgaacaccagauaucuggguaccuucccugcaagaagagagcuugccugcagagaauacucugcccacugaaacuaaggagagugcuacccucccagaucugcuuauagaggcuaacagagucaccugaagaacaagcucuuaacagagacaacuauaacagcuagcuucagagauuaccagauggcgaaaggcaaacauaagaauccuacuaacagaaaucaagaccacucaccaucaucagaacgcagcacucccaccccaccuaguccugggcaccccaacacccaggauuuaaaaacauuucucaugaugaugauagaggacaucaagaaggacuuucauaagucacauaaagaauuacaggagagcacugcuaaagaguuacaggcccuuaaagaaaagcaggaaaacacagccaaacagguagaaguccuuaaagaaaaacaggaaaacacauccaaacagguaauggaaaugaacaaaaccauacuagaacuaaaaagggaaguagacacaauaaagaaaacccaaagugagacaacgcuggagauagaaacccuaggaaagagaucuggaaccauagaugcgagcaucagcaacagaauacaagaaauggaagagagaaucucaggugcagaagauuccauagagaacaucgacacaacagucaaagaaaauacaaaaugcaaaaggauccuaacucaaaauauccaggaaauccaggacacaaugagaagaccaaaccuacagauaauaggaauugaugagaaugaagauuuucaacuuaaagggccagcuaauaucuucaaaaaaauaauagaagaaaacuucccaaacauaaagaaagagaugcccaugaucauacaagaagccuacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggccuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaccaaauucacacaauaucuuuccacgaauccagcccuucaaaggauaauaacagaaaagaagcaauacaaggacggaaaucacgccuuagaacaagcaagaaaguaaucccucaacaaaccaaaaagaagacagccacaagaacagaaugccaacucuaacaacaaaaauaaaaggaagcaacaauuacuuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagagugaaaggcuggaaaacaauuuuccaagcaaauggucugaagaaacaagcuggaguagccauucuaauaucagauaaaaucgacuuccaacccaaaguuaucaaaaaagacaaggagggacacuucauacucaucaaagguaaaauccuccaagaggaacucucaauucugaauaucuacgcuccaaaugcaagggcagccacauucauuaaagacacuuuaguaaagcucaaagcacacgucgcaccucacacaauaauagugggagacuucaacacaccacuuucaucaauggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucacaaaacaggccucaaaagauacaaaaauauugaaauugucccauguauccuaucagaccaccauggccuaagacugaucuucaauaacgacauaaauaauggaaagccaacauucacguggaaacugaacaacacucuucucaaugauaccuuggucaaggaaggaauaaagaaagaaauuaaagacuuuuuagaguuuaaugaaaaugaagccacaacguacccaaaccuaugggacacaaugaaagcauuucuaagaggaaaacucauagcacugagugccuccaagaagaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaucaaggagcugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccaucuaaacagucccauaucaccuaaagaaauagaagcaguuauuaauagucucccagccaaaaaaagcccaugaccagacggguuuagugcagaguucuaucagaccuucaaagaagaucuaauuccaguucugcacaaacuauuucacaaaauagaaguaaaagguacucuacccaacucauuuuaugaagccacuauuacucugauaccuaaaccacagaaagacccaacaaagauagagaacuucagaccaauuucucuuaugaauaucgaugcaaaaauccucaauaaaauucuugcuaaccgaauccaagaacauauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauaaacucaaacaagucaauggccuuucucuauacaaagaauaaacaggcugagaaagaaauuagggaaacaacacccuucucaauagucacaaauaauauaaaauaucuuggugugacucuaacuaaggaggugaaagaucuguaugauaaaaacuucaaaucucugaagaaagaaauuaaagaagaucucagaagauggaaagaucucccaugcucauggauuggcaggaucaacauuguaaaaauggcuaucuugccaaaagcaaucuacagauucaaugcaaucaccaucaaaauuccaacucaauucuucaaugaauuagaaggagcaauuugcaaauucaucuggaauaacaaaaaaccuaggauagcaaaaagucuucucaaggauaaaauaaccucugguggaaucaccaucccugaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauccaguggaagaaagacagcauuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaaugggguacagagcuaaacaaagaauucucaacugaggaauaccgaauggcugagaagcaccuaaaaaaaauguucaacauccuuagucaucagggaaaugcaaaucaaaacaacccugagauuccaccucacaccagucagaauggcuaagaucaaaaacucaggugacaguagaugcuggugaggauguggagaaagaggaacacuccuccauugcugguggaauugcaagcuuguacaaccauucugaaaaucagguuggugguuccucagaaaauuggacauaguacuacuugaggaccuagcaauaccacuccugggcauauacccagaagaugcuccaacaugcaauaaggacacauacuccacuauguucauagcagccuuauuuauaauagucagaaguuggaaagaacccagaugucccucaacagaggauaauccauaucaaauauccauagcaaaugugguacauuuauagaaugguauacuacucagcuauuaaaaacaaugaauucaugaaauucuuaggcaaauggauggaucuggaggauaucauccugagugagguaauccaaucacaaaagaacacucacgauaugcacucacugaaaaguggauauuagcccagaagcuuggaauacccaagauacaauucacagaccacaugaagcucaagaagaaggaagaucaaaguguggacacuuuuguccuuuuuuuuuuuuaauuuuacuuuauuuaaaauuuuuuuuacauuccaucuuccauuccccacccccauccacccuuugacuguuccacaucccacaccuccuucccaccccacccucuaccugaucucuaaacucccuggggccuccagucucuugagguguaucaucucugaauaaacugagacccagaauuccucuacuguauguguguugggggcgucauaucaacugguauuugcugccuguuuggugguccaguguuugagagaucuuggggguccagguuaauugagacugcugguccuccuacagggucgcccuuuuccuuagcuucuuucagccuucccuaauucaacaauugacagaagucagcugcuucuguccauugguugagugcaaauaugugcaucugacucuuuuagcugcuuguugggucuuucggagggccuuugguccuucauagaaaggggaacaauauacacauguuuaggagauacagagacaaaauauggagcagagacugaaggaaaggcuguccagagacugccccaccuggggauccaucccauauacagucaccaaacccagacacuauuguggauaucaagaagugcaugcugacaggagccuaauauagcugucuccugagaggcucugcuagugccugacaaauacagagguggaugcccucagccaacuauuggacugagcacagggcccccaauggaggaguuaggggaaggacugaaggagcugaaaggguuugcagccccauaggaggaacaacaauaugaacgaaccagaccuguuaccuccuuccagccuagcaaggcuggcuugaguggauccaccugcugugcugcuccuuugaugugccacuaccugccugaggcucaacaugccagaggccaaaccaguucucuuccaagaaucuuccggaguuaacaccgaacugagaucuucccacuaaaaggcugggaagaucuacuucagagaaacuuugcuuggccagggacgggccuccccuuuucuuuauaaaguguguuugcugacauuaaaauugaaccuugagcagagagccuugucuugguuccguccuuaucucacacagccuagccgcucuucucuuccaaguuuccaaaaugccuuuccaggcuagaacccgaccugugaucugcuggccggacacaacacagacccaccagaguucccaggaacuaaaccaccaaccaaagaguacacauggaggaacucauggcuccagcugcauauguugcagaggaugaccuugugggacaucaaugggaggagagucucuugguccugugaaggaucgaugccucaguguaggggaaugucuggacagggaauugggagugaguggaugggugagcagggggaucggggaugggauagggguuuuuggaggggaaacaagaaaggggauaacauuauacuuaggacccuaaugcaucugucauuggagacaaacaauguaacuuguauagaguguguaugauuacacuaagagugaagccugccaaacugcaacacccuggagccagguaaggaaugaugcuauauuucauccauguaacacucuuuugcuauugaaacaacacauagguagacugugaaaucauaaauguaaaaccauugcugccauugugacaauauacugacaugccugccuggauguugcuaugcuccugccucgaugauaauggacugaaccucuaaaccuguaagccagccuuaaugaaauauugucauuuauaagacuugcuuucgucaauuggucaugguguuuguucacacauaccaacucacuucauauguaaagagugacuggugacacuugcagcaacugggaacaacaaauauauguagaguuuccacuugaguucugugucacauagucggggcccugcacccugucuuagacccccugucuuuuucauaauuccccauauuaacaguuagugauaaggaacagcccucuauucaguggaaagaaacagaguggucagaagauuaaaccuugagcagaagggaacuuuguuucagaaaguuacugguauugguugaaaguaccagacuccacaggaagcacaccagggagacaucuagucccagaaauguagaaggcuggagagaacucugggaggagaacacagccugaguauucuacuguccacaccgccagauauggaggaagacaucgagucuguuucuuaaaucacaguuuucuaugguugauuguuacagaguucugccuggaugcuucuacauucuucauguuucauagguccuugggggccacaucugugguuuuguuugaagaaggucuccacuguucaugaaacaaaugcuauuuaacgguccugauucuggagguuucucuuugauucaguuucagucucauuuauuugugagucuucaaaggcucuguguguacagggcagaaagguggguguccugggaugacgggaaucauuaaauagauaacguaacaggccacacauucagccaaaguucagugaaacgugcagacuucaaagcaaagcaagcguguaccgauacgaagagagguacaaagaggcagcaggaggaaccaccagaaugcacccccagcaaggucugccaugauuuucccagagaacaugccuaacugggcuuaagugagcagguaucuagggaccaggcuccaggcaacaaaagcagaaagcucuaagccccaggaggcuggugcuccugggagcaucuguuagaaccucagcuugugugaacagagagaugcuacgguaagcaccagagguuucugcagauggugcagaucugaggcucauccgcacugggagaagguugaucacuguccauggaggaagucuucugaaugucaagcaaggggagacacagcucugccgucuucaacauuacuagaaggaaacuggaggaggcugagcuaggaucugccugcuggugacugacuggguuggggguggggcggagagaguuuaugaugaccgccucccacauuccuccucccauucaugucaccccaaagagguagcgcccuauacuuccccacuaaaacauagaacauaagaccugacagaugguauuagucaguguucucuagaggaacaguccuuaaauauauuaaauguauguguaauacauguauuauagaguauauuauaugagguuauaugagauauaguauauuauaugucugcacaaaugcauauauauauauauauauauauauauauauaugagagauuuauuagagugguuaacagacagugguccagcuacucuaacaaugacugucuaccaacagaaaguccaagaauccaguaguuguucaguuucgguggcuggaugucuaggcuggucuucagucuacacuggaauccugaugagauaggcucuaaugacagcaaaggaaaagauuugcgagugagaucaagagcaagcaggcaaagaguuaaagcuccuuucuuccauguucuuuauuuaggcugccagcagaagggguggcccagguuaaaggagaaucuccccaccucagaagauuuaggcagaagguguaucuucccaccacaaaagaaccagauucaaagcaugccuuuccacuucaaaugauuuaaggaaaaaaaugucucacagguaugcccaguggcuuggguuuucaucaauuccagauauaguugacaaucaagaauagcauuacaaauccacuccuugucaaccugacaaucaaguuugccuuaugucauccuucauuucuaaaugaaacaauaaccaggccauaacuaugccuaacaugauauacuauuguauguacaauccaagugcauuauaucuuuaaccagaucauaauuaugccuaauaugauauacuaucauuuguacaacugcaaacauacuguagauuuuagaauggguaucaaugucccuugagggauauucuuuuaguaucuuaaacuuaaguaugauuaaccacugguguucucucucucucucucucucucucucucucucucucucucucucucuuucucucucucuuuuuccgagacaggguuucucuguguagccuuggcuguccuggaacucacucuguagaccaggcuggccuugaacucagaaauccaccugccucuggcucccaagugcugggaucaaaggugugugccaccacgcccugcuuugguguucucuuaggugauguuacauuacaugauaaagaaauggaggaaagaaaacacaaaugucugcacaaaugcauucuuaacaagauaugacaaaaacauucugcuguuuauuuauuuauuuauuuauuuuuuuuaaugugcucuuaaacacugagcaucucuccagccccaacugcacucuuuuuuuuuuuuaagauuuauuuauuuauuauauguaaguacacuguagcugucuucagacacuccagaagagggagucagauuuuguuauggaugguugugagccaccaugugguugcugggauuugaacucgggaccuucggaagagcagucggguacucuuacccacugagccaucucaccagccccauucugcuguuuauaauccauguuucugcaucuggucauggggccuuagauaguauuuguaacuaccuccuucuccuacccauucuguauuuccuccauccucagcgagaaccucagaaggucuuggcucuuuuccuggaggugugacccauaccuacauuccuaaaggaugcccuuagucauccugccuggauuagguugucauaguuucucauugacuuuaaucauggaacauaguagcaccaagagacgcccuaaaggaucuacuacacuccagacauaauaaacuuucuuauuuccacuguggagaagcaauucaauuuccccuugguaaucuagaucaaucacccuuccuaacacugcuauauuuuuuuucuuagccuguugguuuaagggcaucagaagcccaacacauccaagggggaaaccagagauuccaguucaauaacauauuuguuguggcuccugggagagagcucucccuucucugguaacaaaccuucuaggccagcagaacuuaagguuguaggaucaggaagcaagaauuuuccuagugggucacuagagguaauagugugugaaacuauuuccuuuccuucccuuuaauuccuggacuuguggauucuggcuaugggagaaacacauauugggacccauauugguugcugauucaaagcauauaccaccuucuggagaacccugcccaaggcuuccaggcugcagcuaccuacuagugcuguaaccgugucuucaaaagccaucccaucuuucuaucgggccaguuauuucagguugauggggaaccuggugggacuuuuguaaaaauaucuguacaaauacagauauucuuacaggauaugacagaaacacucauuucacuuauaauccucauucuuggaacuggucauguggccuuggcugguuuuguggcuccaugauugugggcccacugucacacuucuguggcuaugaagugagucucuuguucagaagcaaugccaucaugaugaauaaggcaaucuguaaguccaucaugguaguuuuggcagaagcauuauguacaagaaaagcaaaucuauaaccagaauaaauaucuacuccaguaaggacacaauguuuccauggggaaagugguccaaugucaucaaccugacaccaggucucugccuagucacccuggugccauaucuggggcugcucaguauuggucuaugcuuuuggcagagcuggcacucagcaguagcugucgccaugucagccuuggugagcuaaaguccauguauuugaguccauguaaaaccuccaucucugccaguguggccacuuuguucauggacccauuugucagugauagggaaacgaggcugacuguccacagaauggaucauccgauauaccugcuugucaauauccucuucugcugaagucaccuuuugaagaucauuuaaaugagacaaaaauaucuucacauccuuccccauuuggagaaucuacccaccuacuccuuucccagaugucuuccucaucaauuuuccaaucauguucuuuguaagccccugagcaugcaaccaaucauuggcuauagccaaucagugaacaaucgacacaucuggccauuucuccucuaaaauacaugaaugaccaugugcacugccagaaguuaugaccacugugaaggauuuccuucacugguaucuuucagaaagagguuguaauacuguagcuguccacuucuggcuugugccuguuauaacaugcagaaaacuaggucccaaucuucucuuccuuagucaaccaauaauagggaacacacuguaugcuauaggugcaugcuugccaguagaugucauuguaauagguguagacaccauaggcauuugggcaacuucuucauguaacuuggugugccuuuaugacccacucaguaccaaucacauauauacuacuucagucugauaauagauugcugcuguguacauccuacuuuaugacuugcugggucaccuaacacccagcucaugaugagcaguucagguugcuuggcaacuugguggcccauagucaaauguucaguuuccugucucaaagggagaagaauugucugcagaugcuggaagacccuugcuccaaaaucccaaagaucucuuuugugauuuaccuagaggggccugcaacaagcuccagacagcaucccuaccugccacugcuaccucaagugauaccaucggaucugccggguuacugguccaagugguagagcagucuacacagcagccuggacuugagagauuucuccuguucuaggccucacucaaagcuagcaucagcuuucuaagucauuugguauaugggccaggcuaacacauccauaugaggaauaugcugucucuagaauccaaauaggcccacuaaacaugugagagaagccacauacaauaacuuauucuucaccuuaaaaggaauaucucuucaugccucacaccacuggacucccaagaauuucacugagauagauuugguuagauuuacuucucauccuuugauacauacaugugugaccaacaaguccaaacuacuugcugccucugccuacuuugucagcauaaugucaucaauguaguguaccaaugcgauguuuuguagaagagacagauaaucaagaucccuucuaacuaacuuaugacacaggucagagcauggcgauuacuauauccuugagauaaagcuauaaagcuauauuaauggccuuagcaucugaaagcaaauugcuuguagugauucuuaugaacagguacugagaaaaacacauuugcuagaucaauauagcugcauaccaaguaccaggagauagauuaaucugaucaaguaaagaugccacaucugguacaguagcugaaauuggagucacuacuugacagaguuuuccauagccaacuuuuauucucugugauccaucugucuucugcacuggccagauaggagauguggugggaaccaccaccccugcaucuuucaaguccuugacaguggcacuaauuucugcaguuccucuagggaugugaccuuguuuuugacucacaauuuuccuuggcagagacaacucuaaaggguuccauuuagccuuuccaaccauaauauccccaacuuagggugauuagugccaacucugggacucaauguaaaaauucugccaacuucuaagaauauauaucucaaauauacauucucagacuggggaaauaacuucaggaugauuugggggacucacuggaccuacuaugaaucagacuuuggccaaagcucaauuaaucacuugaccuucacaagccccuacuuuaacaggaaggccacaauguuucuugaguucuccaagaaucagcaucaauucaaaaccacuauuugauagacucugaaaagugauuguuuccuuucccccaguguaaguuacccuaucaaaggccauagguccgucugaggaagaacuggagaaaggguaacaguaaaacucguagguguuuuaccaagggaaaacuagauauucauuccuucacucaaagcauucuggaucugcaagcuggcucaagucuaggaaguugauucauggguugagauucccuuuugccaccacccaguguagccuuucauuugaaagaccaaacagaaauccaguagacuucuuaucuauuccaugccuggaaacacccaugauugauuagcugguacaaaggucuucaugagucaggcaccauaaaauucacuuugccugugcaggcaguuauggguugccauuaucgacacugcuuugccugcacugcccauuaggauaaaaacaaucaccuugccuguggagacucauugcuaucaccugcuacuuugggguccaacuaagcccauugcauuucauucauccaacugagaagcagugucuccaacccuaagguacagcacaaggaaagaggcgcaacaaaguucuucagauguguuaaugcucccucauuguuuugugucuuccaggguuaaugccagucaugucuccugggccuucccauuggagaggauuagguuuuacacaguauacucauucuagcauggcaauuuuccugagccuuaaauuccuucaucaucagguagugguggcacaugccuuuaaucccagcacucgggaggcagaggcagguggaucucugaguucaaggcuagccuggucuauagagugaguuccaggacagccagggcuacacagagaaacccugucucgaaaaacaaaaaauaacaacaaaaaaaaaaacaaacaaaaauuccuucaucaacacugauccaagggauaucaggcaucuccaaccccuuuucaguagaccaucuucugacaacugcuuuggccaacuguucaacaaacauuuaaaccauucaaacaauucaaauaaaccauugauaccaucuuaaacucugcgagcuuauuauuguauuaaauauaauauauuaaaccuagaaccuccacucaaugagcuguaucaaaaaacucacccugauucaguuuuauguuucuuccacccuuaaaaucccacacauauuccccagacuuccgcuugaaugaauuagcaaacucacuaaguucuuuaguagucuagcauaccuccucauggacuauauauaccuuuuaucucuucucuaggagccugcuuugucuuaagaaugguuauauguccagaggcaauuguuggugggucuugagggacaucaguauugucuugccuaaucuuuuucagaggucauugaugggaaggauuaacuuccucaggagagagagagagagagagagagagagagagauagagauagagagagagagagagagagagagagagagagagagagagugcaaauggucuuaauuaaggcuaucauugcucugaugaaauaacaugaccaaaagcaguauggguggaaaggauuuaucucacucacagcugcaugucauaauaaaaagcagugagggcaggaaccuggagcgggaacugaugcagaggccauggaggaaugcugcuuacugguuuguuccccaugguuugcucagccugcuuuguaauugaacccagccugguggugacccuauguacaaguuacaaaucccauucuuuaccaacgaaugcccuuacuuuaauugcugacacccucuaagccugggacuugaauuuugacugcaauuuauccaaucuuaggaugaugggggcuuuguuuugauuuuccuugagcucuguggcugcgggagagaagauucucuuccagggcacacuuuucaaacuuuagaguguugacaagcaucuggaauggaucaguuuuugucacugaggucauuguuguccuuuacuauguucugagagucucgagguugguuagcuuuaucacagaacacauucuuuuuccuugucauuuuuauccacagaugcuaggagcaaccaaccagcaauaccuuguuuuuuucaaaguugcuauaaguuuuauauacacaaucaccaaauccauugccucaguauaaucagaugcauuuguauccuuaaguuuguaagucguucacaacauggguuuuuaaugcuuuuuuuuuuuuuuuugaacuucuagaugagaccucuguaacuccaacaacuaacgagacacacuuuaauuaacuguaggcacuggcaaauuggaaagccuauucgaaauacaaacuucauucuuaaacuucuguugcuccagaaccauuucugguggcaaugucuaucaaugucaucaguguccucuaagggaaaagaacuuacaaagugaaucuaagaaaaaaaagucucucacaguuauacccagccacuugaauuucaguuaauuccacauuaacagaacaagucaauuugacaaccaagaaagaauagccaucgcacagccuauucugaucacauuucauuuugugcccaaggagaccaagacccaaauaauuuaggugacuuccuucaagauacacagagguuaaacuccaaacacauucccacauacuguagcuggcacucaugcucaguaucaucugaaguagacucuucauucuugcuuuucagaacucuguauguguacuguguguuguguguuauguguguagguguacacacaacacacaacacacacauacacacacacacuauauauguguucuagaccccagcaccuugcacauaucagauaagaucucuaccacugagugccagcuuuuuaccuuccaucaucuuaaucccuauuccugaagaagcuccacccccagaugauaguuacucagacauaaaaaaucuuuugucuuugugccaacuauauauucauaagaguaaaacuaaucagauacaguaggaaggucucaaagcaauuaaaauuggucuuuaggcaguuuguucauaggaacccaucuggccauuuugguuucccuaugauaguuaaaaaagaacagaaaacauuaaauacauuauuauuuucacuaaguaaauguggggcacugggcuauacacagacagucuggucuccagucgaguugaggucugaaccccaguaaaaccugguggugguaauucccaccuacaugggacagaagguguucccucaugucuccuggaccccuggcuccugucgaaguuaccgcccccauaguccccacaggagaagcuaauggcuuucagucacguagacaaugccccaagcuucugaccuucaggcuagacuccucccaguuaccuagcaucaacaagauaacagaccacuauaagaggggcugcuuggcaccaccucucuccucauccuuuccuugcucucuuaagcuuuuacuuucuuuacucucccucuuacucucuaagcuuuuaccucucucucuuuaagcuuucuuacucucuagccuuucuucucucucuccuuuccccauuucucuccucuuggccauggccggucucucucucuuuuaccuucucucuuucccccuuccuuucuacgaacaaagcucuaaaacuauagacugucucugaucauaaaggaccagacuaaagacucuugccugcgugggaaccuucucccccugcccuuuuuccaguaucuccggagccuggugcugcucuggggccccuauucuguucucaucuccucugcuguauccagcgugggaugccggagacugagaacaugguaugggggggcugccccuuguccacccccuggaugaguggggucaguggcuucucacagccagaugcccacccggggccgagugaaaagcguccagcagugcucccaugucugccugccuagagcacaggaacucuggucagaugcaggcucucucccuccccacuuuucucccacaaccucagccccacaaguaaaugcucuuuuucuuuuucuuuuucuuuuucuuuuucuuuuucuuuuucuuuuucuuuuuucuuucuuucuuucuuucuuuuuuuugagacaggguuucucuguguagcccuggauguccuggaacucacuuuguagaccaagcuggcuucgaacucguaaacucuuaaauauucauuucuaugcauuacauuuuccuaaaaauguuugauuuccuauucauuuuuugucacaugguuuccuauaaaacuccuccaaggaacguugugggaugagugauaauuuuuuaacugugggaagaaauuucacuaauuucugcuaaacauaaagcaaccauguuucuucacauuuuuuuuuuuuguuuuaagacaauauguuaaaaagaaauguauuuuaaccucaaaggucucauuuaaaaucagcaaaauaugaccuaaaauuugcccuuaugagaaccagaacacagagaggcuuuggaauacuccacccuaaaugggaugucucuaucaaacucuuccucuccaagcucagggaagacaggaugagaaagaggaaguggcaagaaugugagagccagaggggaugggggacaccagggaacaagucccccugaaucaacaugaguaaagcucaaagaacucacagaaaugggaucagcaagcacagggccugcaugagucugcaccuggcccuccacacaacccuuccccaggccuugagguggcuaaccuccaacccccaauucuuuuacaacuuggcuggagucagugccuggccuugcugcauuugcaauuuccuacugaagcuuugaggagaugaccaccugcugagcuugcuuugcaacucaauccagcuaaaacaaagggugggucucucucuguguguguguguguguguguguguguguguguguguguguguguguguugccuauauaaacgcagagcugaaaauuaaacuuugagccuugaucagaaaccuuugucuuggcuucauccuucucuagccugccuauucuuuuucauucccagccucccuuucagguagacccaguucauccauggcuguuagacagcuacauauuauggcuuccaguuuaguguuuuuuugggauugcuuagugagcaaaugaaugggucucugauuccugugccuucucuugggcucuuuuccuucuguuaauuugucuugucuaacuuugaagugacagauuuuuguuucaucuuauuauaauuuauucuuaccucuuagaaaccuguuguuuucuaaugagagacaaaaggauaguggauucagauaggaagggaagugagggagaaacugggaggaguagagagaaggaagacaacaaugugguuauguuaugugagaaaauaaucuauuuuuuuaaauaaaaggugaaaaguccuuuaaaaaaauaaagcaaaaccagaacauuauucuuuuguuaauaccgcaucucccaaggguggucacauaggaggugacacugaagacacuuguucuauuuuauagucauguggagugugaugguggaugucagagguaagacaucagauaagggaagaaaaaccaaacccuuggccuagcacaauaaacaggaagccagugaugcucacgugaggcgggaguccuugaagguguccaaguaggcgggguaacuccauuccacuuugcuccccuuacaucguagcucuagaguuugcccugccaggagacucacuguggcagcaggccucuggaagcgaccguugcccaucgcuugcaucaugauggacuggcucuuugcgguugagucaguggagucccuguccuuuaccuuaggaaucuuggguuuggccuuuuuguugguugguuugauccuguuuucucccugcuccuuuggacgcuuguucuuaggagaaugcugaccaccaacugcaaagacaugagaauaaaacacugagcaacauuucccgaguguaaggaacccacagcagguggcuucaacacucucuggccuaugcccaaauccuuuucagccauaaucauaagugacaaagcagucaucauucuuuaguuuagacaauaacuuaaaagaaacauuuuaaggauauuauucaaaauauaaauuugcccuuauaauaccagaauauuuuuuucuuuuguucauauuccaucucacaaagguggucacugaggagggcugcacugaagacacugggaaucuguuuuagaucucaccaaacaccuuuccuggugcucacuuuaaggugacucuuuaaaugcaaagauaucugucucuaaggacaagagacacaagcagcauuagaaaugcauucaggugacuuaaaaccucucucaaaauggaaauguagaaugggcuccauauuuguuguagaaugcaaaguuuauaggguuggggauauagcacagaugguaccaugcuugucuaguaugcaacugagccuuugguucaaucccuagugcugagguagagaaagaggauggggaggcuucauggagaauaguggauuccuagagcucacuggccauccaugcuagccaguaggcuuaauuuggguuuggugagggagaaacugucuuaaaaauuaaagaggaagguaauauggaaagaaacccaacuuugaucucuggucucugcacacacauacaccaccacgaucacuaccaccaugagaaacaaacaaaaucaaccaagacucucaacuguagcgauggcuuaaaguuuagcaaaugaaguauuuuuggaggcauguuuucaucaaccuuguugagaguugccaguaaacagugauaauacagagcuggucugcuuuaaguuggcgauuuguuuucuguauuaggcaucuauuacugcuuucacucaggcaaaguuguuccuacucucuggacuuucuggaggccacugggcuccagaaaucucaaccaagucccuuucagcugugcuauuguguccaccauggaaacguggaaaggugggcuauacagcugggcuuuggaugaacuaucuaugccuauggcaaaguguaucauuugauggccauagaauuacagaagugcucagacuuauagaguccucagaaguccuuuagguaaaguaaaacaaagcaugcuuuaaaaggcuuuaaauaugcuauacaaaaucacuugguugaucaguagcaaaacacuagacugacucaagucuccuuaacccauuucagcauagcaugaucauuccaucgcguggagauuaacauguuguauauauuuuaaauaagagauuauaaaccaugguuaguagagggacucacagaauauuuguaucaaauggggaaaugugaugucaggagaaaaccauugucaacgcauaaccuuauaugauucccuguaugcuguuccuugaguuuugcaacaggagccauuuagccuccacucucagaucagccuuguucaguccuuggaacuaauuugcuguuugagcucuuggcucgguauucaaccccaauccuaccaaccucauuuuggccuguauaccuuguucucugugacagcauucuuuucuguggcuucagaguucuucauaauuagauuccuagacccaacucuccacuuauuuuucuuccuucuucuauucaauuccacuaggcacaugaaaugcugacuuucccaaggaguagaguugugcccuugggcuauccuccaaggcagaguccccaauaccugcuguuuguccagcccugccaaaccugcacauuugcuuuauccacuccugauuauaaugaugaacuagacacagugucucucaugugcaggcucuuuuucauaguucaucuugguugucucuccagcaugaugccaguaggauuuagagucagcuaggagacacagcucuugguaugucugugagaguguuuccagagaggcucaucugaggauggaagaccuuuccaaguugcauacugaauucacaaaagagaaaucaagauuccugaacccaagaugaaacauaccaaccgucuuuucccugcuucuugacuaaagguguauggccaacugcuuuauguuccucccacuaugcauuccugccaugaugaacuguauuacuucaaaccacaaccccacacaaacucuuucccuaaguuucuuuuguguguuguuacuuuguuacuguguuauaguagugagaagcaugaguaacacauuaccuaaccuccuagagggagaaucauuguagccauugggaccagaucagaugggcagaaauccacuaauucaacaucaccgugugugagggacaagccucagcuuuguauugugucagaaguccuauucccuucugccaaagauagaaaauaaaagccuacuauacugauguccaaauauucugugucccauaaguauuuuagucauaucaugucuaugagacuagcuaaccuuuugguugaugcucugaauuugguguuucuacucuaaguaacaucauaacagaacuuucuguauauccuauggaauuuauccaaccagugcucucuguuuaacuucagaguuaucacauccuguguggugacacagcuugacaacagaaguuuacucugauaauuaccauccaaacauuugcuauucuacauggaaaauaacucuaucuuuugaguaauagacuccaguagcucuaacugcccuaccaguaacaacuuucacaggucuguucugagcugccucccaccacccagcucaguauugaaacuuccuggguccucugucauggucuaguccagugagucuccuggacacuccauccaugucuuuuccugaaacccaccaguccauaaccagugcaucucuucuuccugcaaugaagagaagcacuaaucuuuggcuaggacccuuucuuuuucuuucuuucuuucuuccuuccuuccuuucuuucuuuucuuuucuuucuuucuuucuuucuuucuuucuuucuuucuuucuuucuuucuuucuuucuuucuuucuuucuuccuuccuuccuuccuucucucucucucucucuccccucucucucucucucuuucuuucuuucuuucuuucuuucuuucuuucuuucuuucuuucuuucuuucuuccuuccuuccuuccuuccuuccuuccuuccuuccuuccuucucucucucucucucucuccccucucucucucucuuucuuucuuucuuucuuucuuucuuucuuucuuucuuucuuucuuucuuucuuucuuucuuucuuuccuuccuccuuccuuccuuccuuccuuccuuccuuccuuucuuucuuucuuucuuucuuucuuucuuucuuucuuucuuucuuucuuucuuucuuucuuucuuucuuucuuucuuucuuucuuucuuucuuucuuucuuucuuucuuccaagacaggguuucucuguauagccuggcugcccuggaacucagaaaucugccugccucugccucucaagugcuggaggaccauuucuuucuauccccuaaccuacaggauccccaagccauaucaaaccuuuccacccagcuagauuaccccacacucuaggcuuggaacaggaagcacauccuguacaccaugauuguccccucuguccaccugaguucauuccauccgacccaauuccaaucucuaaacccagcccacccacacauccaacuugcucuguuaauaacagacuuagaacaaaagaagaucacaugcccccagauuucauuguaaaaauaccuauaguaugagggaucaaaccacuaucuguuugucaaaccuagacaaacucuaggacacagacuuuuaaaagaacaaucauaaacuuaacauaaggagcuuaaagaagacacagacacagacacagacacagacacagacacagacacacagacacacacacacacacacacacacacacacacacacagagagagagagagagagagagagagagcugaaagaaagcugaaauaaggauggaauuggaaaccccaguaucuuaaucauaaacucaaaggaaaaccuuacauguacaguggaucaagcagaacuuauaauaucagguuucgaagauaaaguagaagaucuagaucaaauaagcaaggaauaugauaauuugggaaaacccccagaaacaacaaacaaacaaagaacccacagaguaaggaacacacagaaaauguggacacuauucaaacugcauuuacauuauagguguagauaagggagaagaauccuaagucaauggcacagaccagauuuucaagaccacagaaaacuucaccagacuuaggaaugaugcccauacaaauacaagaagcccaaagaacaaugaauagacaagaucaggggaaaaaaaaucccauggcauaccacaguuaaaacucuaagucuaaaugacaaaggaaguguacugaaagcuaugagaguaaaaccacaagucacauauaaagaaaagcccaucagaauaacagcugauuucucaguggaaacuuucaaagcuagaagagccuagagcagugcguuccaaguacuaaaaggcuaugauagcccagcuagaguaauauacccagcaaaacuaucugccacaaucuaaggaaaaagaaaacuuuccacaguauaaauggccuaaaaauuuaguaccucacaggccaaaccuaaauaaaauacagggagaaucauuucagauugaagagaggaaugaacagagcagggagucucuggaaaaaaaauacauagucauaauuauuaaaacacacaauaccacacaaacaacaauuacccaaacucaacaacacgauaacaccaacauuucaaugauaaguuuaaaucauacuggucuugauucuugaauuaaaagacaccagcugacugaauggaucuagaaacaaaauccauuuauaugcugacuccaagaaagcaucuuguuuuuaaagauaggagccacguuaagcaaaagauugaacaaaagcauucuaaccaaacgggagcagaaaaaaaaaaaaaaaaaagccuacuaggugaaaaguccagaggcauacaguuucacagcagaauucuaccagauauucaaagaucuacagccaauccuucuuuauuuaaaaaaaaaaugucacacagcuggugguggcacauaccuuuaaucccagcacuugggagggagagccagguagaucucugugaguuugaggccagccuggucuacagagugaguuccaggacagccagagcuacacaaagaaacccuguauugaaaaacaaaacaaaacaaaaaaaagaaagaaaacaaagaaagaagcaaagcaaaaggaguacccccaaacuccuucuacagagccagcaucuuuccaguacucaaacuaggcaaauacaacaggaaaagaaaacuacagccaauaucucugauaaacauagacucaaaauauuuaauaaaauauuugcaaauauauacagaccucuaccgaaaagaugaucuaucaugaacaaguuggcuuuaucccagauauucagggaugcuucagcauguauaagucaauaaauguaauuagccauauaaguggacuuaaagacauaaaucaucugcucauggcaauauaugcuggaaaaacuugacaacauccaauaugccuucaugacaaaaguuguagggcuagagggaacauaccucaacacaauaaacaguaaauaugagaagcccacaggcaacauaacccuaaauaaagaaaaucuugaggcagucacacugaagucagaaaugaggcagagauguccaccauccuguaaucauuuucuaugucauucuguaaauacuagcuggggcaauaaggcaagagaaggaaauucaagggcuacgacuagggaagaauucaaacuauccuuauuuguagaagauaggacaguagacaucagagaccacaaagauucuaccagaaaaagucuagaaauaauaaauaaauucagaaccuuggcaggguacagaaucaacuugcacaaaucaagagcuuuuuuacccaucaacaauaaacauauagaggagacacacucccauucaugguagccucaaaggaaaagaaagcaucuaggaaugaaccgaacaugggauuaaagaacuuccacaaugaaaacucuaggcuugugaacaaaaagaaacagaaagacacuagaaaauggaaagccauccgauguucaugggaauuagcauugugaaaacgaccauuuuacccaaggcuauuuacauagugcaaucaccaucaaaaauucccaucucgaucuucccagaaagagaaaacgauguccuagacugcaaauggaaccaccaaugagcccagguaguuguaaagauccagaacggaaagaacuguccuagagggauuacaauuccagaucuuaagacaggucaccaagccauagcaacguaagcaguguuucugccacaaaacagaagaaggaaacacaauccaauacccaagcacaaguacacauaaccucagccacuuaaugucugacaaaugccaaaaacauugcugggaagagaaagcaucugcagcagauggugcugagaaaacucuaugccuauguauuagacacggguccaucaccuugugcaagcacgaacuuuaaauggauccagugucuaaauguggaaccugaaacacugaacccauuagaagaaaauaggcaauuuagguaaagacuuucuggggggaagaaaaaggucaucaauuugaaagagccaagaggagaauaugggagguuugggaaugagggaaggggaagggagaaauguaauuaucuuauaaucucaaagaaagaaagggauaugacuucuauguaaauauuccaaaagccuuauaaguuaagaauugauauuucaaguaauuagaguggaauucaucaccauuggauuauagaaguuguuguagaagacauuguauagaaaaaugcaugguaaauacuuuggacuaugacauauuauugaccucagauuccacuuaguagcucaccagcccugggaagucacucgugugugucuuagcuuucuuauauacauguagagugacaaugaugguaacagccauucaugggcuuaaagauagucguuuuugauuccaucuguacaagugcuuucccugcauguauguugguguaugugcauguauguaagugcacugcauauaucccugguggcugugcaggcuagaaguggggaucaugcccccuggaauuggagaaauagaaggcuguuagucaccauguggguguugugaacagaacccaggaguuuuuccuuuucuuuucaagccuguucugagcuccaggggcuuagccacaccuguucugaggcucuaacaaauuugugugucccucccucccucccucccucccucccucccucccucccucccucccucccucccucccucccucccuuugccucaaaauuccugguuggaauauucuguuucugagucagcccugugacacuuggaagacuagcaggcgucuucaauuuaauggccccaaagugaacucugaaagcuacucagaccugcuccuucccaggaguccucucuccuacaggcaggaagccccuccaccugguugcucaagacagacaccccagucucgccuuucuuuuucuccuaggcagcagcaaaccccuuuguuuucauguuuacaguacauccugagggcaaucccccaccuccaccccaucuauugccaccagaccuggucaacuugcuuucuucuagauuacuaaugucuccccaaguaggcaguuggcuuccacuuggggcucuucccuacucaaaaccguucauugaucuucacuuaacuugaaagaaagcauuguucucucaugcucuacgaggaccugcccuccccugggucacauuuuaggguacccaagccucccuagguacuggauaaagcucuugggcagccuuagcucuuccuugugacaccuguaggugucgccucuguaucucaggugggcaggcuucuaacucucuauccaagaaacacccccuaacccacucucauaucccauccugagcuguuuaugaacaaacuuccauugcuuuaagccaccuuauuccuaguguagauugaguauuccuaaucuggggaaacaacaacaacagcaacaacaacaacggcaacaacaaaagcuuucaaauucaaaacaucuggaauucucgacaagugaaaaaugccauagccaacugcaagugcacaaaaauauugcuuaaaaucaccuuuggauuauauauguauagcagauacacauaacauacaugaagucuaagcuucaugcuuagacuccagucccacauccaagaaacuugguuaugcuuaugcaaacaugccaaaaaucuggaaaaaaaaaugcuagccugacccacaucuguucccaagaauuuuugagagcgauugucagcuuguucuuggucacagcagcucuaggaagcugacaugcuuugguuagugagaucuaugaugcuugucaguuucuaaaaaacgaugucuucacacucguuuguucucuguucccuccauuugaucaugaagaccaggaagaaaggaccuuauagccuugaccacagaaaacaacccucucucugaauuuuccucauccuucugacagccucucucuuucucucucucuugcucucagacuaaccucuugaauggcacuaaguauggaagacagguuuaucuguuaaacauacaggccaagacccuacaugcucugaaacauccaauaauagcacuuguaagcaagauguauuuugugaauacuuauuuauguaugcauagguuucuggucuacugucuguuuccaagaaguaagccaacacaagaaagugauacauuguucuugcuggauagucauggucacuguaucauuuuccuuaucuucuuucagaccugguuucccccucuaauguuuugaucuuuuuuugaauuuuagaagcuuucagauuaucuaagucuaaauuaucugaaagcuauuggaugaaggggcuuguguagguaaauggagaugcauuaauggaucaauaugcguaucucagcacuugacugucacauuaaauaugcguacguaggugauaggaggucaguaggugacugcaguuuuauacuuucaaguguggacguggcagugcaccacuggacagaacggguccugggagcagucccucacuaacuggggucuuggccuauuuauucacuguuuucaagccuucaguucacgaaauggguagacagugugguccuucaggucuucccauuauaaagagaaauagcauuauuucucaaaaacuuuagaauugggcaagacaaaugccacugcuuaggacagaugucuacuccguggaugcuugcagcgaaggcucuuccucugaggcugucuuccaaauaugaucacaaaguggacaggcucagggacaguuacagucacagcuugugccuguaguuggggcugagggaugcaaccugaccugccaaucagaucucagcacuggaaggacggcaugaauaguugcucucuuuggcugucccugcgcucuuccugucacuacaucaggauucaaaacuaaugacaaaaauucuugaaaggguuaggaaaacaguuaaauaacuuaauggagucaguuuaauuuucaguauguuuaacauuuugucaauggcauauuauauuacauauauguaucauauaaauauauauaugcacacacauaucauaucauaugugucuguaaguauaagggcaagacccacauuuaccuauuauuaauuauuaaauauuugacccauauuccucuuugucucauaaauacuuauugcuuguaggaguagaaguuuauuuaaauagaugcuaauucauuuagacagaugucugccguacuucacaaacuccgaccuauguuggcugaagucaaucucaagccuuuccaaccggcuccaacuugagucccuccaacuccaacuccaauggacuguuugaaguuguuuugucuggccgucuucugcucuauucaaaaaugacuccaaauacugcauccccaccauuuuagcagucagagacaaggaccugccaggaacgauuuaauaccguguugugcagacugagcucagggcaaaggggaacugcuguuccccucccccagaggcucugcuuacacuuuuuuauuuacucagucagagucuguccuuaaggagccucgugcacagugucaugagccaccaccaccuugaacgucugcauacucgaggcagaggacuguagcuuuagagaauggaaacccggauggaagggucgggauugaugaguggaucagucccaagccagguugagccggcuccagcaugggauugcauaacagcaagacacuuuucaaccaaaucuaaggagcacauuuguggcaguaacugaggaauuuuaaggaagccuugagaucggucgccagauguacuaugcaaacagcaacgauuaaauaaaugaugcaggaaauaaaauaauuaauuaaauuaaaauaauuagcagugauauguacuuaaaaaaauguauaguguauaaaaaccacacacacaaacacacacacacacguaauaaagccuaauccuacgguuaucugucuacaauacaggauggaccuagggcagguacacaucucaaauaaacauuuuuuaaagugauguagugguuggugaaguggcuccuuuucauuaccauagcgcaaggaggaagcucaccccugcacggugccuuuugauuuucauaagucugcuguagcauacacacucccaaacacacacacacacacacacacacacacacacacacacacacacacacacacacacacacacacuaaaugcaauuuaaaaaauuaaaugaugcaaggcccuccuaugugcuacaaaaaaaaaaaguaggcuuuguuuccauccauccucuuauuuauacggaaaauauaacugcggucuaguuuuuuuuuuuuuuuuuuuaaauugguuuagugcagcauuuuguuguuguuguuguuaaaagaccuaggcaaaucuagcaggauuuuaguucagauugguauacaacaacagcaacgacaacaacaacaacaagcaaacaaaacaagacuguaauggggaaggaagacacacagggaauuuuccacaagaaucucuuugcuuagguggcaccggcuacaauaguccagggcgaggaucggucguauaaagguggaagcgagccacugcgggcgcgccaucagaccgacacguugacacagggggcuggaccaggcuccgucuggggaagaugggguagaucgguucgaucgccuguggcuuucugauaaggcuagagaaguccugauaggcucuuucggucagugcaaccgccgccuucacaggaguucuucagggcgaugggggaaaggaaaagaagaaaggggacccuucuaggacgagccagguacaccggaaggugaccagcgcuggggacgaucccuauggccaaaaguuagaggaguugcugagagaaucucggacugggcgaaggcggucagaagccagagucacucaccaucuuccagcgcuucguguagcaacagaaguccgagcagcagccaaaacuucaucuucagggcuggugaccugcagaauaguucaggacugcagacggcgcgacaggcuguccagggcagggcaggggcgcagaggggaggcggcgccugggacaccacagcuggaggauucgguuucacugggggaaacaca

SEQ ID NO: 12417 - RNA, 142816 nt, Mus musculus
auucaaaugcuuagauaugucacuuuaucaaagcuagcacaaguucauuuauaaagguaucaaaaucacaucuuuuuacauugaaaucgccacacucagaguacugauuuaaaccccucuauucaaaaauaacugcauguacacuauuaacaccuuagccuuuaauauaacauagaugaauggacugaagaagauucagcuuuggcuaagaccggucuugaaaaaacacuuaagaccacagcuguuccaauuuucuuuucgccuugcagaagaaucauucaaacuagccaaaguuucguucucugacacauguauuuugaauuugaaaagcuuaaucuuaaacucaagcucugugagccaauuucagccacaacaaauuuuggcauuggguucuaaguucuguauaauagcauagggcgccuggcugccuuaacuaaggagggaugagaagggggagcauauaacuuaacgcuuugaagaguaaguaugucagaggcugccauucuuacauugaauauuccagcauuauuuauuugaucaaaguaaaauacacuuucccauugcuauaaacuacaguuguucacacacccacauuuuuuuuaaacgaugugucaacaauuuuguauuguacauaaaauguuugguuuaaaaaacaaaacaaaaaaacccuuaaaugcucucuaggcauuuuaauugcuguaagauuugacuucccagacaucuacgugguaugagggauggcaggucaacacuugagcuuuaccauaacuagggcauaaaugacaaaccugacuuuggcuaacaucauugagaacaacuugggaccaggagcagagcuauuccaggagguggcagugaagcugcaaucauuccuauuuaucgggagcaaacaugguagguuacauacaucauaaacuauuggagauaagagacuucaaacacaaccccuaauaaaaagcaugcaucaugacuaucaguuagcucuguagugcagaagucuaggaugacucaccucuaguauccugaaucuguccucgcuauagggguuaucugagcagcauugaccaugaauuaguaaauacugacaucgcaaugccggcaugcacagggaaguuuguggguugggugguggggagccacagcuauccuucuaacuuucacagagccuuggagccuagggagaugguaagcgaagaucugaauuuugaaugcagugugaaggagcugcagaagccauaccucucacucuuuggccacucuguuccauuccaguggcuggaagaaugcucagaggggcccaagucagcauucccgcucuuggaucuacucaacacagaacuguuggcuuaacucugugcucauguggauuaguacaugcuaaaaugccuuuacugguuucccccccgggguuucuaaaauuguguagugucagaaccagagcuuagcuuauuugggaaacagguucagcaccuccaagauaaacuggcccuggaaaagcacacucuguggguaggaaggagggcgcuuugcuuccguggcucuacauggaggagaaggcaaggcggagguuagaacaacaggaggguagacggaggauuagcgcuaugaagcuagcuuggguucaagggaaaaaaauaaaccagaaacauccauugguacugcccccuuacucuuuauacagauuuguauuuagaaaaauuagggaacuacauuugcucauagccugagaaaaugaaucagaguauagcaauuaggcucgugaaaaucuacagggggaaaaaaaaacugcuaucaacggauaaugccgaacauggaaaaacuaacaacagagaaauaaauguacagucaucaagaaaccaaaggcuuuuccugucuugcccgagcccugccguggcacagugcugagaugaguuggggggaaauucaagcacuauugcuuucucuucuauggcuuuuguugacgcucgugugccgauuaugacuugguuaauacaggccaagcuauauacagcuguugacuuuuaauacacagcagggggcggggcuaugacagucacgugacacgccaguacacccauuucacucacacacacaccccccuugcccacagucagacugaaauaaaaaucacaagaaggugucucuggugaagaacauuauaaagguuauaaaucuuuaucuuaauagggcccugagaguuuuccccuaugcuuaggugaaggaaggcaaagaacaagguucccucguuccguaagugcuuugugcaacuauguccacuucaguuccgaaaucuguuuuuggaggaggcuuuuggaccaaguuaaaagucuccuauuggagcucucuauucguacguagcugaaacgguuggcggcugcucucccgauauccuggggauauuccagagagcuaacgcagcaacucgaguucccaugaacucugaacuucgggucagucccgcagaagcgcaccucagugccuucagagagucuccugcguucagaagccgucaucugggugagaugcuggggcuggagaaggaaccagaauuccugggggacuggaaagggauggccgaggaggugggggaucucuuggggcugcacaggucuccguugugcaguuuccacagaaguuccucguucuccauggacagucucuuguugaccuucgacuccuucucaagggacuccugcagcgcggccugcucgguggaaaguugccuggaaaacaaaacccagagagcauaugaauccaagucaaaaaggaacuacuacuguuuauaucugaagguucaagaaacuucuucugggggaauacacagguucuuguccagggucaucaauuuuuuuuuucugauuuuucucucauauagcucauccucaccacgauuuccccucccuccucuccucccacuucucuucagaaaaggacaggccucccaggacuaucaaccaaacauaggguuccugguugggguuuuuugguuugguuguuuguuuguuuguuuguuugugacaggguuucucuguguagcucuggcuguccuggaacucacucugaugaccaggcuggccuuuaacuuaaccuguuugaagcaguccagagugcugggacaaaaggcaugugucaccacuggcauaugggucauagauuuuuuuuuaagcugagaaacccaacuacuacaaauaaggaagcauauagaugaguguuagaggacuugccuaaugugugugaggcccccuggcucaaggucuguggaccacaaaaaggaaagcaaaacucccgaauaccagagccucaagccugacccaaauaaauaauccugaguaauugcuggcaacucuagucuuugggagauuucccaguaggcaauggggcacuugcacaaggcuuguuuuauuucugucuuaacucaaggccucuuucuguucacguguguuguuaccccuugucugacagcgccauuacaguuagugagcugcaguuaggugagaggucuagggcaccuugguaaaugcaugaaccauucuccugcuucucucacaugccugggaggugccugguggagcguagccagaagggaccguagauguccgaggaugaggaaaggggaaauagacucuuguagguuuaccuugaaauugccauguguuuguccaugcgagcuuuuaacuccucguuuuccugcuggaaucgcuucagcuugucaaccaaugcuguguuauuguccaccuuaguauaaaacaagguuuguaguuauauauauauauauaagaaaugaauaaauaaacucucucacuucuuaagcauauucccaauacacggcaccaucaacaaguugaucaggaggagccauaguggcacacugaugucuucauacaccgaccacggugaggacauguguucaucaaacacagaaauaagagagcuaggcaguaauguuuuuauucuaggugacacuuucagagauguccugcugggagcugguguccugccuaggugaccaugggugcugggucucuuccucaaggcaguaaaggaaacacugcaguuuaacugucuccguucacacaaccccuguaucuacagcacucguguacacauacgcaaagaaggaagcggggagaggaggaggaggaagggggagaguuagggacagagggagggugagagggaggaaggaaaaaagaaacuagacagaggaaggaaggagaagaggaagggagggagccuauaggucuuggccauacugaggaaagccuuaaacuuauuccaggaugguuuuggcauuuaccuccagguggcccuauggagauacaauguagcaagguuagguaaagaaguaacugaagaaagcaggcuucccugcucaguucaggccaagggacacuugugcucuuuccagccuuacacaaacugaucaguugagugguuauaggcauuuaaagucacugaacauggugacccacugaucccauccuggcucccuuccguaaggaaugguuuauugcuucuuuaagaggcaacaucaaagcucagagugaacuuaacaugaggucaaaaaugaacccccaagucccugucauggcagcuggcuauggcgcaucuguuuggauuacagcacccaggugaaauucuuguuuuuaagacauccuugaguccagaaaauccucaugacaugccauucagaugaaauaacuuucuaaaaaaaaaaaaaaaucuacaggaugaaaaaaaagaggggugggggaguugggcaggggagaaacaccuugaaaugcuuuucaagguaagacacaaccugggaaaacuuggaauaaaaaaacaaaaacaugacaauuggccucaaaccauuauucuaucaaagcuuugcucuacugaggucaaaacuccaucuuugaugucacagagcuucccacuggcagagcuagcucucaaagcaaaccugucuuccuuggauaguuuccucaugcuaagugugaugguuaaucugccaacuugacaccaccuuagaauuacccgagaagaaaaccaaugaaagacucuauauaucaggcuggcugugggcaugccuccgggggauccccuugucuaaaugugaacagcaccaccuaguagugacucagccgugaggaggcagacgaaaggcacuuuugacucugcgcuuugcuugcuuggcccuuauucucacuggggaggcuacgugcccuguugccacugcagacgauucugucucugauauuagaaucagcuucuucagggcuuccagaguggacuggugaucaaaaggcucuucagaagucccacuggccuuugguaccagaucggaacugcagaggcgcccaaucuugugggcagccacggcuggacuaguuagucuaagcucaucauggaagccagucuagcaaaucuuccuuuaauagaucaguguaucagcucuguuccuuuagagaacccuaauacacuaaguguucuaucuucucuaaagaccuggugcugccaaguauacaacacagcaguggcaacaaguguacccaucgucuuagcaaccuacauuccuguaaaaacaacagggcgaugccaacuggcacuguucagucggggcacagaacagaacuaucaugacucaauagaaauuaaaauguguuuguacuuuuacagcagggccuuguaucacuugagauugucugauaaguuuagguaccugaacgggagauggagcaacacauuguuaacaggguuuccugagucaucauugccagccugcugagcagguggcgcaggcugaccuuugccaagaagugcuguguguacuagguugggccuauuaacaacuaggaguuucaggcauucguuuaaaaaaaaaauccacuuccuguacuccuggcaccuccaagauggguagauugaggagucccagcuguauguaucuacuaucauugugacacccacuugacagaugggauguauucucucaaacuggaacugggcuggacuuaaaaugccaguugggagaaauuccuuaguagcuuaggagacgauaugcaucuuggugggcaagaaagcaaucaugaaccaacccagcggaaucaugaugaccaaaagccaugaggaugaacucaggcugguucuauuccuagaaacaugucuggccuacacucaugucacugucaucugggggucuuuacugugacugcacucaaaucaacuccagcgagcccucgccuucauguguuugucaacagacuagacuagacugcaguguaugcacgauuaucaucucaguuccacacacgagagaaaaugauauuugucuuucugggccgggcuuucuucacuuaauaggauaaucucugccuccaauuacugcugcaaaugacauaauuucauucuucauuauggcagauccaaacuccgcagcguauaaaaaaaaggaguccucuucccccacuuccacauuuccugaugaagugaaguaaugccuguguguucccuuaagcacugccucccucaaaaagcaguuaauuaucucuaggaaucaaaacaccaaacuaagccaaaucccccaaaccagaaaagccgaacagauaaagaguaaccucuaugcucccuauuguucaaggcuaguuuaacuuugaaugagacuuuucuucaaggcguagcgagucacccacaacuggguggaggagacacaugcagcccuggauggcuggcaguugggagcaaaguacagcaagcaacagcuagggccacuuaagcugcugagaaauccuuccaucuugguucauguccuggccagcagauccugaguuucagggcuggaccaaggcugacagugcacaccgggcacaccccucaaacacagccuggaguagguuuaaauucugauuaaugcuugcuguuuuccaacugggcugaucaacacacaauucuuuucaucauagucacauucuuaaaaagauacagaaugcuaauagauugugugguaccagugaaguuacuggauagauccaacuguccuucugucuagaaugggugcugcauuaacauacugguuuuagaguaauuuuucucauuaggcaagugaagacccacagacuacugaaaugggaaccugauuuguuauaauuuuuccaaaacuagaugcugcuuugcaugcacucuauaaauaaauaaauaaauaaauaaauaaauaaauaaauaaauaaauaaauguucuaggaagcagcaacuaaucuggaaaggaaagugcaacucugacccuuuguguacuuuccaaauaucaucgaguacaaguuagcucugcuauauagcuucucuaagcucugcuauucuauuucacaggcaacuccguacgcacagcuaugcaaacagcacaugcgcaggaggcacaugugcgguaggcgcucacucccauccugcaggagacauaccagcuuuuccaucuucauuagcuucauguccugcuggugcagcuucucauucuugaucucuaacacagccuucaggcuuucuaguucuugcuccagauacaugaccugaggguuuuucugaaaaaacaaaacaaaaccaaaaacaaccacuaagauaacugcucugacuuuaaucacauauuauacagucuaaccucuugauguacugauuucucugauuagucuuagagaaacaagcaauaaauuacuuacucccuuugauuguuuguuugucuuaaacacagggucaugcuuugacugucuugauauuuauaguaguucuccugccucagcuucccauauugcugggauuauaggcauccccugacauggccagcuaaauguaaguaaguuuucuuuuuuuuuuuucuuuugucuuuuuuucauacaagguuucaugcuaucaucaggcugaccagggacucauucggcucaaucuggccuugaauuugugguuauucuauugucucagguucccaagugccagaauuagaaagaugagucaccaugccuagcuuaacuucuuacaucauugucaaagaaguaaaaaagaauuaagaaccuucuaaucucaaagacuuuggucacaguauugaaaacaaauuuaucuuuccccaguuauuuaguaugguagauacuuucaucggaucucuuauuaggaacaagaaaccauugcuuacaacauaaaaacagagcucaggagagagagcuuucuccagcucuaaacuaguaucuggagggagaaaaggaaacaguaguuuucucuaagcaaagucaguaucugaggagaaacacaagcaaagacagugucauaugcagggcucugggaaaugacacagagcgauaauguccugagccucugggcucuccucaugguuaccuuggcuucgccauggcaacacuaccacagaacacauucacucucccaaauggacagugugauaccaccacuguggaguaucuccacagcccacuccuggucugauggaaauucaaccgaaccacgcaagcaggagggaaacccagcagcagccggaauacacaacuuacugaauucgccuucucucuugacaguugcuuuugcuccucugauuucaaccuuucguuuaaagcaucguuuucacucuucagaucauugauuuguuucuaaaacacaaacaguaacacguggagcgucagaugccaggaaaggaccggaggcauacauacagaggccucguccaaggcggcugcgggggccaggagcgagccacucaccuccagcgauuccugcuucucauuaagcagauccuccagugacuucuucuccaucucauggcucuucuugauuucuggaaggcagggguuuuguuguggguuuuuuucuuuuaagguaauacaacccuaugagaucacuacucuccaaccuggaguauauagacucgggugcugaugaaguaugacuuaugauacuuuccauucaugagaugcaauucuuuaaauuaagcggcaucuccucagaauagcuuuaugaggcaggccagagauuuaugguacaaugaccagaaacccugaugcccacagaggccaaggaaaccuucaaaaucucaaaacgaaggguagggccucaaaagucagguuucugauuccuuauuaggggcccggucuuccuagaagaaauuugcucuuccagaagaaaacagaaaucuaaaauuaagcccucucccaguaggaagacgacaauacuuauuguguauaagccagccaucaucucugacuccccacaguguaaucucaugagaaguuucucccaaaggucauagccauuuuagccacacaucccccugcuacuauguaagccacagcugacuuguggugaacacccuauauugcauugcuggcuuuguccucaaagaagacaaggagguuucucccuguuccuuccuuuugacaucaagcuuuccagugcuggugaaaucacaacagcauauccuguccuuguccgucaaaucccaccugugcucuaccacagucaugaaugcaagaaugcguacguguggauuccgugcagcacugagcuagaagcugacaccuugccuuucccgggaccuaaaguagcaaccgccgccaaccacaaccaccaccagagagguuuuuagaaucuuuggaaguucacccuguuuccuaaaggccuggcacgaauaaccaacuauaauuugcauccuuaagggaaaagggcauccacugacaaugaacaaugcacaaagaaaccaagaggucugccaagugaaugcuguaggguguucugugcaagggagaaucaugagucaguuucguuauaguaaauaccacgcguuuccacugccugucuccugaagcaggagaagcacccuugccugaaagggagguuucauaggucuucuucagcaauuccaccuucuccgaguggcuagcuucaaucucaagcuuaguggucucaugggcggcguuuaaguugucaaacuguaaggaacaaacagaaugauuauucucuagcaagaagaaaagugcuaagucagaugaaggagcauacacuagggaccuccgucauccguugcagccaccuaacacauguguagaacaacccacucuggcccugcccccccucccacaacucaaacccauucuccccaggaacaaagauagcccaagcacucaaguccaccucaaggaguagggcuacacuucacagguccaccucagccccacaccuguagcacugaccacucuacucuuagcccccaguacgugucuggcgugugugugugacacacacauauauacauauacauauauauacauguaguagagacuaugaagauacuaaacuuaaaaauaaaggaaauaggaaacagggaaauuccaaguuuaugauacuaaugggaaaagugguuauugaaaaggcaucuaaaaacaaaguacagaccaaugguuuagaagccaaacacugggaugcuuccaaguggauuguuugggguuauuccuaucccuucuauuaaaaacuuguuaucaaacuccuagggauugaccagagcuguggacauccuuugcaaccucuugcugcaccucuaagcuauagcucugaaccuccuuugcuuuuauuuugagacaaucuuauaaaguugucucagccucugcgaugguggucagggauaugggggccaggggguguggcacuauuaggagguguggccuuguuggaguggguguggccucguuggaguagguuuaaggcucuuguccuagcugccuggaagucagucuucuccuagcagcuuucagaugaaguaguaaaaccuucagcugcuccugcaccacgccugccuggacgcugccaugcucccaccuugaugauaauggacugaaccucugaaccuggaagccggccccaguuaaaugcuguccuuagaagacuuuccuuggucacaguaucuguuuacagcaguaaaacccuaaguaacuagagcuggugggaucacagagcuuguuuuuuaccugucuaucugucugucugccugccugccugcacuggggaugaauucagagacuaacaggccucugugucacugagaacauaugugguccuguuggcaguuguuacuuccgagccagggacuuaaaguucccugugcuggccuugagcucucucugcagccaaggcagggcucaaccacgauccuucugcuucaacuuucugagaguuggggugcugggugugucccacugugccuggcuacuucccgcuucuuuaacucaacacugcuucauccuaagagaaagccaucaauccccaaagcuuucuccagcuaaacuaaaaaggcaagggauaacuuaugaagaauguagacagcaucuagaacggcagcagacagccacgccggagcagcccagccgcacagaccugcucuugcaguugaguuuuauauuuuucugccuccucaauguaaaugcucugaagcuucucacacucugcgguguauaaguccuucagccgguucuccaguuccguccggucugucugaugcugcugguuuaguuucuggacaaauucuugauacgcugucuguaagucaguccuagccuuuucuagcuucucacaggcgcuugaagcagcaacugaaaugggcagaaagaagaggagagggccuuuuacauuugcucaggugucgggagacacaccacauuuacacaccgcugggaugacucuggaggcauacacauggcacuguuucaccagcacugcaguucaaguaagaaacguccaucaaaggaggcucccagggccaaaggauggugguggaccuuaggucacugguacacaccuccgagagggagaccaugaugcuaucuuucccuuccucacuuuaacgugaggaaaaacauuguuuucucaaccaugugcuugcccuaacacgacaugcaccugggcacaaaggagcggggucaacagauccuggccugagaccuccaaaauggugagccacaguuuaucuugauaaauccuuucucuuugucauucucuguaauucucucucucucucucucccucucucccucucucucucucucucucucucucucacacacacacacacauauacacacacacugcauuuugacuguugcugccauuaucucccaccucgguaagcauccuucuuccacuuagaaugauguccucagugucccucugcacuguggcuugugcugagacuggccucccuuucaggcugacuaugacuccacugaccguacacaucauguacugacccacagauggcacgugcuacuucuaccacggguccaccuggaacaaugcugcuaagaccaugggaacccaagugcuccgugacccugcuuucaacuuucuugcuuaucuaaaagaggaacugcuguuucauauagcaauuccgcuuucaguuaaaaugguuuuacaauguaauaggcaagauucaauuucuccacauccucaccaaaacaugauuaaaaaacaaacaaacaaacaaacacaaaacccacaacacaaggagggguauguaguaaggguuggaggggggaaaaggcagggggaaaaugaugaaguuguauuaaucuuaaugcacauggggagauacauuauaauuuugguuugagcaauggauuuuuaaguagagucacaaauacauuaauaaaauuguaguaugaaggcugaaauuuuuauucccacaugauccauaccuaacaguauauaguguuccuugacuacuaaaacaauccacaaagaagagccaaguucuguggugugugcucugcaugccuuauuccuaguaauguagaggcugaagcaggaggaucuuugcauuugagucuauccugggauacauagcaagacaaacaaagccuaccaugaacagacagacaaaagucauaaacaaaccaguucacaaagcaggaauguuggaggaaagagccaaaauggcaggugaaagccaaaugacaggggacaucccagaagacauuugggauuaaauacuacacuuuuuuucuuucuuucaaagaauuuaguaaaacauaaugaaaggccuuaauuacuaacaaacauccuuacacugcuuauaagaaaaaagauuuaagacauccagugguacucuaaguagcaaacaauauuagcuuuugccaacugacuuuccaaccuauaaauaggagaacaauggacaucuucccauuagguccccuguguaucccaaguuagaccuuucugugggcaaagucuauaaaaaugcuuuguagccaaucgaugaggaggggauccguuucuagagagggaaaugcuaguuuuagaauuuuacacgucagcagauaacaagcaagcaagcaugaccgagcucauccagaaacccacgcuagacacaaacaucuccacacggaagcaccuuauacagaggccccugguauacaggcaucuuggcaaaccugccacucaggauaaacgaaaagagacagucagcaucuacugugggcacaaagggcuucuaagugcaggcuacaccugccagacuuuuacacaucugcucauaaucaaacuauugucaguuugauuauguuaauuacagugcaucaauguuuaaaaucaagugggauacacagagauccucuccauuaaccacuggauagggcuguuugcuuuguuuauacacacaaaacccaguagcccaaacagugugcagcuuggcuggcuacuguaagcucagugaaggggguggggguguagaugggaaggggguaccggaaaagagaaagggagacagaugggggaucggauggccuacuguuguuacuuccaacaaccaaaggccaggccaggccaggcuccagaaggugacaucagccugcagcugugcaagggaccuucugcuguuuacagugcuguacacaacagcugggcuacgcgucucacccucacaaauggcuuuaguuuggaucaaccggccugggcucguaaggaggcugugauuugguagagagaccccugacuucuuucugagaauguaaacaguguauuaagggcucucagggugcuuccugucugacgggacauacauguguguggugggggaauaaggacuucaccccucaauuuuaggcuauagauuuauuuuuggcuucucauagcauggagagguugcagggccaccugugcuggcuucugccuauccuuugccuucuugcuucuuugccucaaguccacugcuaucggucgcuucaucugacaaccagcaaagccaaaagaaaaacaggucauccaggacuaagaaugagugagugacuguggaguaccccaugcuucgagguauaguuggcuuauagaaguuacaacauguauagaaaaacucaccccaacucccaagacaaguucucaccguguagcucuggcuuuccuuaaacucacagagaaccccacccacccacccacccacucccaucccagaacacugggauuaaaggcgugcacugcuacucucggcauaagccuuuguuuuuaagcaccccauuagucgaguuuaaaagcuugugcaugauuaagcacacauaaaauacuuucaagcuugaaaagcuaguuccagcaaucuaguuuaauacagccagaaccuggcauaguggugcacaccuuuaaucccagcacgugggcagcagagacaggcaggucuuugugaguuuaaguuacagugaggccagccucacgauacagugaguuucaggacgaccagagcuacagagugagaccuugugaaaaagaagggaaaagaaguaugguuagacaugacaguggacacacaauauccugauauucagggaucuggggcaggaggagagagaguucaacaccagccugggcuaaaugggaguacaaagcuagugugagccgcacaacaggugucucuucucccaaaaccaugggcugcagauguagcugagugguagacaacauauguagcaugcacaaguacauagacauagacucauuuacaaaacuaugucuaaaguucuaagucauguuaaagauaguagagagagaugcacuggccccgagacuaucaggccaaggccagagcgggaaaaccaggaagccuugcccugucuaaaucacagcuauuugagcaaggaaaagccacugcauaagaaguaagggaaggcugguguuguuucccaaacaaucacuuggaugacgucuagaaaaggcuccacuauacagcccaaucugaccuugggaaaacacaauccuauuacucucaggcccuuuggcaguuaggaauggagaggaagagaagccauuacuuaauuaguccccagaguggcuuuuuuuuuuuuuuuuuuguaaggugggggaaugguuggacugguuguuuccaucucacagagauaaauuucccuuugcucgcugacuaaugaguguucuguuauggaagaaaacauagcacacccauggucugaaaaaugucaauguucuuggaagugauacagagcugccuucuucuaguaugugaauagcaggcuucgcagggggauggcuagcagucagugcuugcauuuccucaucucgaaaauagaggccacacuggugcuugcccuauugaauuaaugauuauuaaugauuaggagggggaagcgccucgcccugugcuugaccauuuaaaugugugauauguguuacuguuguuauucuagaggaaucaaaccugacuguaguuuucuuggagacaugcuagaagguccaaacaaacuaaugguuauugaguuugaacuccagcaccuaccuucccuauauaauaccuguacauacacacacacacacacacacacaguagggugcuucuggagucuccucuucuaaaucuacuacagcuacuguacuuuuauauucuagacaacagaacuuccccagcuuccuggagaucugccuguguucuauaaacagaccuaaaacgcaaucaagaaugacaagggaucgugggagaggcgaggucaaauggaaagugaggcacauuuggugccuuguaagagacggugacaaacuggaaaacgggaggacuucuguaaucaugugacucugcugauaggguucugggaagccagcugucugugggaagccuucggagcuccccuccacuucacauaugaggaaaauggggggagccauugcguccaccuugccuuaccgacuugguucuccuucccagucucucucucuggccacguggaaccagucaccugcuuguacuuuucaugccuuucuucaguaccuuauuaagaacuuucucucacuucuccugguccccagcuccagaaccauaccauaggacagggcccuucccccaugauuacucuauaacauuacuccacaagaucuuaucaugauacacuuucagguaaaaucuaaucuguuuuuuuaaaagaucaaagguguccaugagaaaacuaacccagaaagguagggcccagacugucugaccaaaaggcauuucugacuuucuggaccucuaaguccugauuugcagagugaggaaacagcucuguguucugcuggccucucaguuagggaugacagauaacggcaaauuuggaguuguuauagacgguacagaaagacggggcaggaggggccuugagagugccaaagggcggaggcagcaugcaggaagguggucgccuagcaucacgaccuucagaguuuguuucuuuaaagguaaccuuucagagccaaguaaccugggagacacgugguagacaagggucuccucuaaauuucaaaaaucagcaguuagugacuuuguucuuaugcacgacgcccuugagucagucuauaugaacaauuucaaaaucucccaccaauuguaaaccuuuggggaaccgacuuuguacaaaaccgucgguaccauugaauccacuuuaccauaaacaauaccacgcuaccugucacacuggcugcagaccuugcgagaggcucuuggguucagauuuucaugcagggcucugagcugacaaguaggugccagccacccuaagucucauuuaaccaaauggaacugggagggcagaccugaaucaaucaugacccuugaaggccccguguuccaggcguggaacucgguacuggaucucacuggcuacuuccgugauucaggauccaaagggcggagucaguucagguggccagugugcaccaaagaaugcucuagcucaugucuccucuggagccgcagagacugaaagauaaguggagaacaaugcuuccccgguuccucucucuuuccuguguugaucagguaguuuguaaucuggccccauuggccugucuuccaccuuccagacagagguggccagcugggcuuccagggugcgguuuccaucuuaugcccuagccugugucaggcugcagaaagcugcucacagugcacacuccacacauacgugggggggaaaaaucuagcaaugaaggugggucagagacagaaguguggcucaauaacugucgguguguucuaagacucaagccugagaaauacgagucccuguguaaaguaccagguuucuucaaucaaaacaauacagugaaccccagucagguauuaacuauuccgucaugccgccuuccauccagaucaguugcuuuuagggcagaagaaucaaaaagugcucguacaagaccucagaagugcauagacuuucgacauauaggaauggacucuuggagcuauuuaucguuagugugcuaauagacacacacacuuuuucacacauaaggaacacucuagauagugcggugucuggguguagucucaggugcucugguguccaaaucaccuggaugauauuagauuucuggacuccaucccaaacuugaaugaguuggaauuggugggugugagaacaggaaaucugucucaucucaccgugacguuugugaaucuguguucuggacaagugaccuggggugaggaacauuuggaaauuuagaguuagcaagagaccaggacaagaaagaaaucucaugggcucucauagcagggugcuguuggcaguauuuugcuuaucugugggcaaaagagcaugggcuuuuggauaucaguggagccagccaaaguccaaauuuaggaaagacacagauaacaagagaauggcccaagucugagguagcuaucaacuagcccuucaaacaucucaccuaguuaaagagcucuagguaggguuuccuuaugcuaucucauuagauucuauaggaagggagggagggagagagggagggaggaagggagggagacagggagggagggagggaaggagagagggagggagggaggcaggcaggcaggcuugaaauuaguuauacagaaugucuaaauaucuuuagacacaggcuuguuacaccagagcuggguggugcacacauucacacguuucacaagaugugagccagucuacguaggguucacuggguaagcgcugaugagguggcucauauucugcuguugacaacuugauuuuuaaguaguuaagaagauauucagacuuagcaauaguauaaguugucuucccugcuucaauuggagaagggucccaacaagcuguuaguggucaaugcaugcuuacaguggagucaaaugauuuugcacugguuuacaaaguuacaccaagcacuuucuuuccgggcugacaaaugugguauccuggcugcuuuggcuucuuauccaaacacuuuggcuccugagcagguuagcagcaggaaaucacacuaggccuugagucucaauuucuucucuuuuauacaauauaaacuacaguauaccugaauauugcucuguuuaggaaugaacagaacccagagaauguccccaaaaccuaugaauuucuauauacggaggggaaaguaauaaagcuuuuacauauuuauccuaaagauuuuuaacaauguuuaguguaucaagggauaaaaaucucauuugguucaaugaaauaaacaacuggggcuccuuaauaaaaagcugugugaguuagcucuaccuucuugagaacacauacacacacacacacacacacacacacacacacacacacacaauaucuuaucugaguguuacccaacuuucaaacaaguuaauguuacuuuuucuauccuucccaugguugcuggguucacauuuauuuccuuggggcuagagguauggcucaauguagaggauuugucuaccacguacaauauguacaaugccuuggguuugauccccaacaccacaacaaccaaaucuuucucuuuauauagaaguguaauuuuaaggacaacagaagucucaaagauuacaguaagaggccuccauacaacacuuuuauuucaaccugacugcagaaagaaccacaacggcuuucucaguuucaaaagcuugcuuuggauguugaccaugaaauguaacaguaaacuacuugcaaagacugacauucaagauucucuggugaaccgcugucauggugaaaccuagcacccacaacagaguuacacaucaccauuauuauacgguauucugaaagacagaauuauuaccuuuuaaggcaguucauaggaaauguuugugcacagaacccuucaaacguuugcacacuacagggagaagaucaccuuccuugucuccaucuuaggcuacaaaaucuauucuuuuccugcucucuaugcacccgugugccccaggccuacacaccugacagaggguaguugagcucuaaauggcaggaagaggcucauaagcaaauagcuccaagugcaaagucuuaauguguacccaguaaccagaaagguagaaaaaguaaaacuaacucguuugaaagauuugggugaaacucaacugaagacaagauauuuucaacagaauggaaaacuggaaaacaaugaaugaacaaguaaauaaaucugagaguccagaguagaggaauagcacagaggacucuggaaacgcagggccacgcaggagaaagcgucaucacacuggaucagcaggcucaccgagaaggcagggccucuaaggaggcacaccccugcaggagggaaggaaagacuuaaaaaaacuacaccucugagucaugaucauaugggcugucuuauugccauagcauucuagagaugcuccacaaucauuaaaaacguccucaguggaggcuccaaggugcccuggaaaagcacugggcuuguucaaagaauccaaagacugaugagaaaacaccccagaaguaugccccucugcugaagacgccagacgugaacgagacuacagacuauacuuucauuuauacaaaacucaaggagagacaacauugguacuugguccugaaaccagaucauuauuugcuucuaagggaggggaggcuuaagggaguuuucuggaauuacagaaauguucaaugcaaggggagauuauaggaaucugauuauauaaaacuaauggacuggcuugauagcucagggagggaccaaggcuuuccaccaaaccgaagaaccagaguucgugggugggacccauaggguggaagggaagaacucaauccugaaagcuguccccugacuuccacgaagcugcuguggcacacacauguggguaacacaugcaaauaaauguaauuuuuaaaaauaucauggaucagacaaaggcacaaagaucuaguuuagagccagccaagucuacacauugcugcccuguuucaaauaagcaaaaaugugaugguacaauagauauuacuguauauaaaauaggcuuuccugaaauaauaaugguacaaaguuauacauguucuauaaacaaaggcacagggcuaugcaaaaguaugccaaaauagaagaacuauagaguauuucuuguuuauacacugaucuuuaagguuuaaacucucaaaugccaauaaacauaagccacuacgcuaugcaaauggagaguucauuacgauuuuuuccucaaagaggaaguaggagagacucuccucauugugaagaccauacagucuggagauaacagaagaacacaggauauauuaaauacaucagugcaagguaggagggucacugguguaggggagccuugugguuugauucugaugagacagagggguuucucaaagagguucgcccaagcaaagggcuuuccacgaagggaugugggucagauaggagaaacaugcugguugugugccagacaaaaagaagagacuauuagaggacgaaaugagggcauccagaaagucugccaauggggaagauggguggaagccauuagauugugaagggcagagguacagacgauugcaguugcaggguuccugggccugagucucuuucacccuucauaguucuucaagggugagacucuugucccaguuuucagggacacaguaaagaucacagcugaccagugacucugacagccccugguuaguccaagggacaaguuggacacuuggauggugcaagugauggauggaagaucagaucucuaagucgccuauaaaaagcaucggggguuaggcccuaccaccucauauacuuuaccucagacucuacacuaauucagcaaaauacacagacacaucaucaaagggaaaacuguguacucaaaaauaaguaacuccuaacugggaguguaugcauaaaagccuguaucucuauccgggcagugagagugcacaccuuuaauuccagcauucaagaggcagagguagaaggaucucccaguuugaggccaaccugguauacagacugaguuccagaccagaccagaccaaaccaaaucccccauuccucuaaccuacauuaaaugccaauagcagcgaaggucgggucucccugucccgagggaucucuaauaguaucccaucuacugacuaguccuucccacgguauaguuuaugcuuucauaagaaggcauuucaccaaucacuacacgccugcaaaacugaaucugugaguguguauuuguguguguguguguguguguguguguguguguguguguguguguguguguuuggcauaggcccucacuauguagucagacuaaccuuucacucacuaugcuggccugggacugguagcaauccucuugucuugaccucuggaguuacugggauuacagacacacaccacgacauuaacuuaauaccagauacauucguguauguauggcgaauagcaguuaacaccugguauggccgcuuugcaaaguuuuaccuaauaugaccuucaugaucauccuuggggcacacaugcacacugucacuuuagagaaaauaaaacugggacagaagagaugugacaugaugggcucugagccacccagcucccaaaccaaggauucaaaccuggagacugugagaccacagugcgacacauuuuauucccucaaauaggaaaacgguuuugacauauauaaacuuauaucuuuuuuccacucuggcccaaaacacaaauccagcugaaagcuacaagaauuuucuuuggagccagcuucauuauacuuguuugaagguuuucuucuucuauucgcuggccaaaccaaccuuuucccaaaugccuucgcuggcccuuaagcaagcacugguccuugagcaagccugucugauucaguaguuaacagaaaugacaccauuucccaaguccaguccuagggugacaaaacaauguggacaggccaccuguaacauccugacacuuugacagcagcaggaaaaacacaccaggccacguucuccuuaucauggacagagaggugagacgacaaaggcuggcuguuuccugacaggcugcacaauaacagcaagugugguggaccucggcuccaauuuaaacugcuuaaugcugaagaggaucaccauucaaucagagucaaugggcucaguguccuccucugucuugguccugccuucucucggagaauagaaaccugaaucauuaggcaggcucaucuccacuuccacuguguuccgaugaacacugaaacucacacaaaaauaccuucucccuugucuccuuauucuguauccauuaccguacuuaaggcacagaaacaacucgagcuggucauuggguaaccaaaagggaggcagccagacugaauuagaaguggaaggucuucauggugucugggaucggggucacccaagcugugccuucugucccgguucgaaagagcucacccaucacugggcuucuguacuuuaucaucugucuuaaaauuauuguuccacaaggguucguccuuucuguuaccugaugccagccagcacugguggcuucucuacuguuguggaucucaaggguuagcgaggaauuggccuugacuucaacuggcaggccaaggaguagggaagggcacaaucuugccuccacaugaacuggcccaugaccuuugucuugacugggccagugcaguugcugacuaauauucuuguccagcaaaucagaauggcgguauuuaaacuacagucugguucucagagaaaaacaggauucuuugagaauuaaacgaacaaaacuuauucuaucuuuagcuguucccuuugaagaacuuaugcuacacaugcuucuaacacagccuaucagcaagcaaagccaaggacaaggcaggugacauuugcugaacaacuccagaucuaguugaagcuaaaucgggaagccaauucuuagggugagugguccccacagacagggcaaggggaggggggcacagcagaccgaucucuccuacagguaauccagguagaaagggcaacugucuuuguccuucaaaucuagggauccucagaggcaccaagaacucaaaagaucaaacagcaagacuuccuagagaaugcuacagagcacaccgcuccucgaguugguagacacuccuccccagcucaucccgacuacuuaaggagcacagagcauggguggcccuaacaagcaguauuccuuuaauuguagacucacuguacacucacagguacgcuguaccacagcggggauguguaacguaaucacuucuaucagagaauagcuuuuucuuaacacucuuuaauauaaaaagucguuccagaaagaaaaagaaagaaacagagagagagagagacagagaaagagagacagauaacagacagacagacagacaaacauaauuauucaaugggaaugcacacaauacagaaaccauucugucucugucuacuccauacgaagcaaugcuuuaugccuuggucaucagaaagugaguguuagcucacucagagcagugccaggaauuuugugagcuugaggucacacugccaagauucaaaagcagugucgauaguaagugucugcacagauacgagagagggagaaagaccagcuguccgcuguguaacuccagccacagagcaggagguuagagcacauugcucagguucaguaaacuuuacccagggcaggggcaggggcaggaaaacaggcucuuaccuagcucuccccggaggcugacaaguucuugagagaggguuuuguguugcuucagugcuuccucccgcugcagaaaacacacaccaaguuacuaacguuuuuuguuuuguuuuguuuguuuguuuaaagaggguucccuuucaguaaaguacacacuuaccacugcugggaaaaugagacccagaguugagaggccgagauacgaaucacuaagcuaacaguuuguguuguuaaaaacaaagcaaaacccagaugucccuuugcugugaaggaauuucauguuucaaaaaagaaaaucuguauuuucccagguccuguugaaacuuuccuuugaggaacaagagaggcuauuuaaaaauauuugcuuugcgccaugcacuuacuggagauccauagacccuugaagcuaaugcauacuguacuuaagauguaaugcacucuccccuccaagggcaauaagggccuaaucaguucaagauaaauauuuaauguucuaaacauaggcauuuagauagacuuugucccauguccgcaaauaaaaaaguuuuguuacaaggccaagccuauauucugaacaagaggaaaaaaaaguuugcuuuuaagcuaggacaaauaaaaaaauuaaucucuuaaagaugaaaucaaguugauuucacccagcuacacagcaguuuccaaggacucuuacaucaugaagcaacuauaauucuaaauaggcuugagagaagugaagugaaagaaaucaggaggguguuucaggguuuaaagaauaacaaguaucagucuugcgguaaggaauaauuuucacguuaccuucaggucuguagcaggcacacauccacacauacuuauacaaacacaaucauuagacacaguuccucaagacggagagucccuggcgccagggugaaacuaggaagugagagaauguccaggcuuucaggaagggcacuuccugagaugaccuuagaugugggacuccagccggcaucuggguugcaguauggcagagagcacgagacuggucucugcagucuagacuugcuucucacucaaagcacuucccccugguuccagacagggucugcaguacguagucccugacacccuucuagaaaagcccuguaaacaaauacuaauuacccuuguugcugcacagggaggagagaggcacauuuugcugcuagggcagcccauuuuccagcuccggucucuccaacucccccacccccugcacuguccaagaagcgcacagguggccacgccucccacccauccguccguccgggucugccuacauucaaagcuccacagggaggagcgccauuggcccugguggccuccccgccugucccgcagguuacugccucagacuccucucucuccucucugaagcugauacugcagcuucugucucuggcacaagcaacggaugauuacuuaaagccacagcccuucauuuaugagaaacgagagccagacauuauccugaucgauuggcacuuacuuaauaucagcgggggcagaggaaacagaaacgggacccucucugcguggauaauggaguuauuuuuagaugugugagccuuuuuacuccgcucucuaauugaggucauuagauuaucgcacucacuaauagaaaaaggggguuugcucuucagaacccauauacuaaaggcaugaugaaccucauggugaagggcacccagggggcccugcugugauuuagaacuuuaaauaauauuacaauagaguauaguucauugauaauacauggguauuggggauuacauauauuugaaaucaccagucaggaauuccaaauuucaaaaauaaacgauugcuuuuguaaugcaaaaacuaaaguuugagaacaacaaaauaauaacccacagauacaauguuuuucucuuuucuccccuucuuacgggucucauacuugcuuuccuuugccccagucucccaaguucugggauuacaggcacgugccacuacagccugacuauucgaguacugucacgucaagccuuaauuuuauucaaaugcuuuggauaaauggcagagucugucaguggcgugagagaaaagcggggacagcucuauuagacaugaaacugugaccacgcuucagaguccccuuucccacagcagccaaguugcaaacaaaaggggguaaaaggacaaggaaaucuuaccacuugcacaagaaaacggaaaggaagauggcaaaagcugacgcuacugaugcuuaucucuaaaggacucuggaaagccacaccucccucccuccagaaacacccgagggaggggugguuagcuuauuaguggacuucaggaggcaacagauuucagugaguguugacaucuguccuaacucacuucccuaaaccacacucagccuucuccagcaagauccagcgugaggacaucaaggucaguugucacugugucucaauggccggaagugggggugggggaaagccagcccacucuuccuucacaauggcuuuuugcccuuggugucaccuuugcuucuaguccugguucuuuagagcccaguacgcaagcauagaagggguuucuuuauacccuagagggcuguuauucaauauuuucuguguauaaacucccuucucuuuugaguauguuacaaaugacacugggacugaagguggagcucagguagcacccauacaugaggcggaauuucuuccuccagcaaauacagcauacauacauacguguagcaagcaugagugggugcuagccugugugcuugugugcgcucccauggacuagaauugccuagcuccuguuuagcaucccgagaucuuccauccaagucaaaagcuauccuucccagaauccaugcuacccucuugggaugacgggcuuucuuaaccugacucauuuuauacacuuucuggaaagccaacauccccuccccccaaaugcccagaagggacauuuaucuuucugaauuaugaguuauuacucauauagcuaagcacauuuuauauccuauaccauaaugauauguaagaaaauuaagacauagcuccugccuucaaggagccugguacuuaggagggcaauguccaggaccaauucuuuggucaucaaucaaagcagaugacaucaucugaggcgaagcagcgcaggacuaugggaaacccggggcuuuaauaugaucuacucaaaaaugcagaccacagagcccagacuccaacagacauacuauuaguuucugcaugacugucuggguugccugcccuuuaaauguacuucuuauuuacucaagaugauaaaauacauucuggcaguuagagaccgauuuuuuuuuccagcugcuuagauuagugucucugucauagaugauaaaccauuuauaauccagagaagagguuuauuugauuaucuuuguacuauaacaugcaaccccacccucgccccacagacauacacacacagugagacuagagagaaagguggaaauccacacgaagaugcuuucaaacucaugcauuaaauauaugaagcgcuuuaaggaaaaaaaaaaaaaacucaacaacaacgggauucuccguaauuuaauuagggucucugggaugcaagcacuuaguggcuggcugucgucccgccagugugccugacuucugcaggcuacugaauggcaucagcaacacaggaacuauuacaggaaagagcugcagagaguucauacuuuuaucauuguggacacuuccuucccacccacucccucauccugccugcucccacccccaccccaccccuuuaaaucugagauguagacuauuagcauaauuuaaaacccuuugggggggggagguacuagccuagguuagauucuauaugcaaaaaaaaaaaaaccuaucuggucuuguuuuaccuuaccaagaaauaugccuagagacccuuugaugaggacucuaggguuacuaacagcaaugcugguuaauaggauccaaauguuucaacaguggguacaagagaucucuguaaaggguuaaggggauuuuuaauugcucaacuuacccuuucccuuucagcuguuuccuaacagugagugccuuguacacacuaggcaacuagcgaacauucacugauggauuauaaaacagagaagggguggagaacauccaacauggggauucugugugcucuuguaagauguuucugcaguuccacccucgcccuucgcucguccacucagguacugucugaauugucaacuucaauucuuggggugguuuuacaagaaggaacuggaagcagacucugcuaucaaugaacuuucaucguaaggagccaaaacagaggcuggagcaaugagucagugguuaagagcacuggcuugcucuuccagagaacccuggggucaaguucaauucucagcaacuaaggacagcuuacaacugucugaaaguccaguacccucucuucuggcuucugugggcaccgcauguaaguggugcaaagacauacacgugacaaacaccuaaaauaauaaaauaugcuauuucuuuuaaaagcagaagcaagcacagagugaggaguuaucauauagaaaggaaguauaagauccuggaguccagaggguggguaaagauagagcuagaagcccccggggucuccuuaaggagggggcccaugggcuugauauucguuaaggucacuguuacacagccauucugcuguggauuggaaagaaacacucgggcacugaaagcuugacaccccagcaugcugguccuguugagagacauggaucaugaguacgcuaacuucaucaguggauuaguuuucucaaggugucagagcugaaugggcuguuaggagguagaacaugauuggaagugggguuuuaaaggguacaguuugugucuggccucuuccuuucucuuuuucuuucucucuuugucugucugucucucugucucucugugucucuuucgguuucucucuguuuuauuaucuugcuguuucucucucucucucucucucucucucucucucucucucucucacucucucuugcucuugcucucuuucucuugucuaugauggcgugagucacuaucuccaucacuugcuuccugucaggauguucugccucacccaaaagcaauggaccccaaaaaaaaaaaaaaaaaaacauggaucuuuacaaaaaggcucuugaaacuccuuaaggguauauuguauauuguguaucauucaguauaccaaacccagggccacuuuaauucagggcuacaucuauuuguuccuccacagagccccugaugaacuacauggauuggguuuaggaaccacuucuucugggcccaaaagucucucucucuuuuuuugggggggggugggggguugagacaggguuuuucuguguagcccuggcugccuggaacucacucuguagaccaggcuggccucgaacucagaaauccaccugccucugccucucaagugcugggauuaaaggccacacccagcuaaaaagucucuuauuaacacuacauguaucuauucuguaggauacucuuucuaaaagagguccuuugagagacuaagagagucagaugggagauuccaaagcauuaaccaugagggaaaguguauguaauuuagaccaaaaaaaagaaaaaacgaguggaaugagacuuucauacuauuguaaaucuggaguucuauaaaauagcauaggccaauuaucauuuuacuaccaucuuuccagugaagagacugggagggaaagggacauaagagcauauuuucagagaaggccgauccuauaggagaacaagcagugucacuuaagccggauuugucagacacuggacaccaaacaccagcugacaugaggaccccaauacacauauaguagaggacuuccgagucugcguucauucagagacgacgaaccuaacacucaagagacuggaaaccccagggaguuuagaggucaggugggguggagggugggaacauccacagggagacaggagggugaggagucaugggauauagagcagucggaggguggauggggguguggggcagggaauggaauacggaguguaaaaagaaaaauaaaauaaaauuaaaaaaaaaaaagaaccuauuugcaggagauggcucagcaguuaggaguucuugcugucaaagcaaggggaccugaguucaaaucuccaaugcccuaaagcuaagcauggucgugaguguccauaaccacagccuucggagaugaagucagguggguccugggaauccucuaggccagcagccagccuggcugaaauuuccaguuaaagguucagugaggaaccgugucucagaaacuaacacuagaggaccagcauccugcucuagccucugcaugcuugggcaccagcacccgcauguacacaggcuuguccacaggcuuguccaccacacaaagaaaaggagggagggacgauaacagaaaguuauuguaacuccaaauccaucuagagacuggcacaaguagaaagugggugauaaaauuauaguuuggggcauggcaugggguuagcuuggucauaaacacaaauuccucaguuuaaucucuaggacccucaguuuuaaaaaagccaggcaguuuugagggcuggaguauuggggguguggggacaggcagauuucugggauuugcuugcgagccagagagaccaacgaguagaguuucgugcuagugagaaacccugucucgagaagaagguagauggcucccuggaaauaaaugagauuuuucucuagucuucaccauaaacgcacauggguaaacacacgaguacacgugcgcacacacacacacacacacacaggaauuggggcgcagagagacggggagcagagaaauagaguucuagcucuugcagucacuaaguuaagcacauuuguaggacaagcauccccgccgcccaccagugaggguugauagacguccuuaccucagacaggaggugcuggaucacaacggucagcgcuucaaacuugguguuaccacgggaaagaagcugucugaggugcaggaugaauccacuuuggcuuucacauuuugucuuguauugggccaacucaagcguucucucggaggacagcacaucuggagcugucugggucuggaugcauaggcuccugggauucuucugccugcccuuuucaacugcaagaggaaggaaagaaaagcacaaagaagaugcgcgugagguuaacuaauuuuuauaaccaccaccaccacauggggcucacaaccagccuacugccgccacaccagagcaucugaaccauguuuuacguugggacguacacaugguggcaggcuggaguagaucggggaucaggauggguggaacucgucaacagggccaauggcuuuaguucucacugugaagauuuaauggggaguuaugcacaugagccaaacagauuuagcaacucagaaacauaaaacacuggaggcagggaagaggcaaaauagugacuucguggccuuuauuuuuaauucaccauuguugucuguguucaugauguuaugugcaugagaguacagguucucaaagacuacugcgguccuguggcggucagaggaccaccuccuagagcugguuuccuuuuacuaugaguuccaggaucaagcgcaggucacuaggcuugcauggcaagcacuuucaccugcugagccaucccuccaacuccacuucauaguuuuuacucuuccaguuaaguugacaaaucugaaaguccuuuccugugucuguugggguagucccgcgauuucuguccuugaguccguuugugugugcauacgcgcauguguauguaagggggcagggggagagagaacgaaugugagucugcuaucacagugacgcaguaaauuauaccaggugacgaaaaggaacaagaguggcacugcacucaugacacaggcugaacaaaguacaauuauacaguaggcagaacuaagacacacuauucaaacgguuucccauuuuggagaaaugcugaagcuagccgguagugcacuuaaaucuaggaugcgguuuaaauccccuugugucuucaaacagacgaugaaaggguaugauuaaaaagcagagauuuaaaaaaaaaaagaaaagaaaagaaaaaagaaaucaugggauaagcacugaggaaaauucugauuauuggacuugaaaugcuuuucuuuccucucgaaggcuccuuuuuaaaaaauuuguuagacugggcauggugacacacacuuuuaauuuaauugcuugggggcuggggguggggaggcagguggaucucugaguuccaagacagccuggucuacagagguuuuguaggccaacugaggaggcgcacugagacccugccaccaaauaaaugaguacauguguuauuuuuguuuguuugucagcaugcuaaguaauaggcuucauuauaguauuucauagaugauuuguuuaaguuuuaguaaguucuucacaguugcuugcuggucugccuccuccacccuaaagcccucccauuuucccaggaaacccuuccuccuuuaccucacugcccccuguacccuuuccacaaacaccucccacagagcugucuuccccgcugucuuucuggucauugucacagucuacucugcagaugucaccgaaaucuaaugacccagcauauacacuggagauccugcacuuugcuccuccgagguuacugggaaaagcagcgugugccugugcgccuggauacacugccucauuuuucaacaagcgcaaacuucguuccccguguaguaaaaaaaaaaaaaaaaaaaagaguguaaaaauguucucaaaugcaugcuacuauuccagauucaucuacguuuggagagauugcucacuucccaugcuguguucugggaacaaccgguuuuaaaugaaaaucuuucuugcaguuuuggaagcauuccaaacgucaaguugcucuggguaaaacaggaagccuacugcuuggugucuggaaauaaacaggcccagcaaucaaaacaaauauaaauauggaaaaaaaaaggcacaugaaacuaaaaaaaaaaaaaaaaaaaaaaguaaaauaaauguuuccuuauugugacaaccagcccccauggcgccguccauccacauucugcacugacaaauuugacagaacuuuucuuuuuuuuauuagauauuuucuuuauuuacauuucaaauguuauccccuuuccugguuucacuucugaaaacccccuaucccucuccccuuccccugcucaccaacccucccacuucugcuucauggcccuggcauuccacuacacugggacauagagccuucacaggaccaagggccucuccucccacugaugaccgacuaggccauccucugcuacauauguagcuagagccacgugucccaccauguauuuucuuugguuggugauuuagucccagggaacucugggguuacugguugguucauauuguuguuccuccuagggggcugcaaaccacuucagcuccuuggguacuuucucuagcuccuucauuggggacccugugcucuguccaauggauagcugugagcauccacuucuguauuuuugacagaacuuuuuaagcagcaagguuuuccucucauuuuuaaaggauccacaaacuaucauccaagaaugcuugggaaacaggaaagagacuucuggauugaagagcucugggguuacucuugcucuugcuuacacuaaaaauaauauuuaaauauacguuacauucaaaacuauauauauuugguuuuucaggacaggguuucucuguguagcccuggcuguccuggaacucacucuauagaccaggcuguucuagaacucagaaaucugccugccucugccucccaagugcuggaauuaaaggugugugccaccacaccuggcaaaacaauauuuuaaguaucagauaaaagcgcccucguuuccuguggcuccuuuauguggugaaacagucccuaagauuugauaagccucacuuuuaaacugacuaagauucccguugucuuacaguacucaagagaccaggaaaacauuccucauucuuuacgggaugggguuuucaaguuguuugucacuaaccgccacuucucuagauacagacuauauauuaagcuugauauugccauaaaaauaguccagaaaaauaaauuaugaaucacuuucuauauuaaugacaaaaacauaaauauuuaacagcagaucuacauuuuccauguacccguuccuuaacaguggccuuuuaggguuacuauugcugugaugaaacaccaugaccaaagcaacccagggaggaaaggguuuauuuccauucagaugcugaucuaacaguuuaucacugagggaagucaggacaggaacucaaauugggcagaagccugaguguccugggggagugcugcuuacuaccccacaaugggccgggcccucccacuaauuaagaaugaauuaugaaaaugcccaacagccugaucuuauggaggcauuuucucaguugaggcucccuugucucagaugaguguagccgguaucaaguugacauaaaauuagccgguauaauguacuaagaaauuauauuugccacagaauagauaagaacaaugucagcauuuacaguucagaguauuuccucuuuuuccucucuucuuugagcuuugaucucucuguagcccaggcuagcuucaaauuccugggcucaggaauuugguucccugcuguagcuuccagagcagcugugacuacaggcacgugccacccaggcuauccccuauccugauccuucugguaccuuuguaggguggguaaggcuaguucaggugaguguaaacaacucuggacagacauuuaaaauccagaacaccgacagucugcuauccucacacacucuggaaacuggaccgaauagcaauguaaauuguuacauacuacauuguuacauacuuagaaacaaaauguagcaaacuuaccagacuuuugaaacuaacagaugacuguuaguuuaaacgguagcucucaacugcgcccccuuccccccccacaauguccgggaucagacuggggccuuaugcauacucggcccuccaccacuaagcuacaucuccagucugaggccaaucuuuuauguuaacauucuagagaaaauacucgcuaauauuccuggggacuuauaaauaccucaugaaaguaccgcauauaaaacuacuagcagugauuaaccuccuugggcuaaggacuagaagucacaaugauaagacauuucaagucauuuucaugucuuuugcucuuuuaaaaaugcaucucugcuauaagcacuuaaaucuuuacucaacacguggccagcaagagaguauagucuacucagagucuuucccagggcaauguagacaagagauuaaagacacaugcuguuaagggcuugaacaaaacugacaacuaagguggaaacgacaaggacugcgacuuguuuuccgagaguaccacgcuuuccauugugcaugcgcugugcccuguguuuggggcuggacaagcacgcgguggccucaaucgucgcuccacauacuguacucccucaggagagcaauccugcaaggcagccgaugacccaguucacacgucuuucccuguccucauuccugaggaucagagagaauacgaaaaucuccagugaugcucaaagcucacauagauggguugguuacucugcaacaugaaaagccaaggguuuccccugagcccugcgggcuuuacuguuuacacaacaaauuuagcauaauauggagcaaucucuggccaucucuccuuccacgcccuuacauguuuaucagacuauggaaguuacuguuuuaguaauauggcuguauuuuaaaaagauaaaccuuuuuugguuuaucauaucuauguaauguauuaacagaacaagaucugacuucaaugaauccauuuaauuugagacauuaaacucaaaaggugggaccuuaaauggggagagcccuacaguggggcgagggaacuuguaaagcccaccuccggcagaaagacagggcaucaagugagggaugggauugucagggcaucaagugagggaugggagguccagcaacaggcccaaauugggauccagcucaaggggaggccccaaguccugacacuauuacuaaggcucacaaaaagggcuaacaaaaaggggccuagcaugaccucacuauggaagacccaauaagcagcugaaagagucagaugcagauauguacacccaaccaauggacagaagcugcugaccccugugguugaauuaggguaaagcuggaagaagcugaggaggagggcgacccuguaggaggaccaucagucucaacuaaccuggaccccaagaucucucagacacugcacaacaacuaggcagcauacaugagcuuacacgagacccccaacacacauacagcagaggacuaccagaucuggacuuagucagagaaggugcaucuaacccucaagagacuggagggcccagggaguggagaggucuggugggguggggacauucucauggagaugggggcgggagguagggaggggaagguauuggauguggaacagucaggugaaccaggagggggauaaaaucuggacuguaaaaaaagacuaaauaaaauaaaaaauuaaaaaaacccugaauaguuaucucaguugagaaacauuauauugugaacuuugugaauuauuaaaacuauuucuugcuugccuuauuuaucuucuagccaggguauuugcuacaugaaggcauugauaaaacaauguacuuacaaugguaacucaauuaagcucagaauugccaauauauauauuuaggaaaguacuucuuguauuugcauuuuugaauaucuaguuauauaagcauuauauuaguguugucaucugugccuggugcuuaucuaguauauaaaucuaucaguucaauauucacugauuaauuuuucuuaagacaucacuauacauucaguugccaaauucaaauuccuauuaagaaaagaaauagcuauauguaaaugcuaaagguaugucauagaaauacaaaaauguaaucuaaauuugcacaaagauuguguuuaaauuuuuugaacuauaagaguaaaggauuaaaaaaucaaaaaaauaaauuaucaacaaacugccacugccacuucugguccauauguacuauagcuuuaguaauuuuaaagcacaaaccagaaaacaaaacuguuugugcacagauuugaacaagauguggguucuggaauugagcccaggucuucaggcuugguggcaggugcuuuuaccugcugagucaccucaggcuuggugcgggccuccagaaagcuuuaacuaaaaauaucugcucacaauuccaccacaucagggacaggacaagguucuucacucuguccguaucuauucaauauauuaccugaaguuuuagcuagagcuauaagacaacugaaggagaucaagaggauacagauuggaaaggaagaagucaaaguauuuuguuuuguuuuguuuuguuuuguuuuguuuuguuuuguuuuuguagaugauaugauaguauacauaaguggccccaagaauuccaccagggagcucagcugaaacacacuugcagcaaaguagcugcauacaaaaaaauaaaaacaaccagaaacccuccuauauacaaaugacaagugaacuuagaaaaaaagagucaggaaaaccaacaccuuucacaauagccucaaauaguauaaaauaccuuggguuagcucuaaaccaagugaaagacacauauaauaaaaacuucaagucuuuaaagaaaauagcugaagagauauaaguagaugaaaagaucucccaugaucauagaucaguauaauuaaagcaguaaaaauggcuaucuuagcaaaagcaaucuacacauucaaugcaauccccaucaaaacuccaacaccauucuuaacaggucuugaaaggacaauucuccgcuucauauggaaaaacaaaaaacccagaaauaguuacaacaacacugaacaauaaaagaacuggcguucucaccaugccugauuucaagccauacuacagagcauugguaauaaaaccuucaugguacuggcagaaaaacagacacguugaucaaugggauugaacuuaagaucuagacauugauccaacacccauaucgacuccugauauuagguaaagccugaaauacacacuguaaaaaagacagcaucgucaacaaauggugcuagucuaacuggaugugugcauguauaauguauguaauacaugugaauagauccauaaacuggaaacagccuagaugucacucaacagaagaauggauaaaccaaaugugguacauaucacaauagagaauuacucagcuauugaaaaaaaaugcuaucaugggauuugcaggcuaaugaaccagagaaagaagagcucaucuggaacgagaaagagaaauaugauauaaacuugcuuauaaauggauauuagacauuaaguagaugauaacaccaagccacaaucuguagaaucagguuagguaugaggcaugagcccagugggggcugggaggguacauagauuucccugggagggggaaaacaaucgauuuuuauggcagauugggggcugauggggacaggaaaauggagaucaaguuguggggagauggaguggagggagagagaggccuggaaucgagacauuugggaaccuagugcagugcaaacuuccuggggugaugaagggaaucuuaguuggggcuccuuguaauagggaaaaugagcucucaguugccagugaugggacugagcugcauucauuugaguuguugaagagggucccauggaaauuccaaaacaacacaggcuauugguaagauaaaugguugcucuccaaagaccaacaguggggccccauuaccgaggacaacacccacacaagucacugaacauggggauguaaagcuagugcucacacagaugcuuugacccuacaugcuagcgucuuuuggggcagaaaggugcccugcagacuacagaaagauaaacauagauaacaaccuuuggcuuaccauccauucugcccacaaacuuugcuagggcaaugguggcacagaacuuuugggaggaaccaaccaauaucugauuugacuugacgcuuacucaaggaaaggaacuaagaaccuaagaaccuaagaaccaaagacccagagaccuacgguaaaaucaaauaugaaugacuggucuuuuuuuuuuuaaguaucgauaaaauuacuccuaaugauauucuucuauauucauagaucaguucuuuauccacucaucauuggagaagccuccccuggaggaggaaacagaugcagagacccacagucggacauuauguagagagauaaucuacaugggauuucugccucaaaucccuucccucacagcucagggaaccuuugggaagaggagucagaagggauggaagacacuaggagaacaaggcagucugaaucaaccaaguaaguaagguacacaggaguucacagagacugaagcaacuaguguggggccuagaugagucuacacuagacccucagcauuuagaucauagcuguuagcuuaguauuuccauagaauuccugacuguaagaacgaguggaucucugacucuugugccugcucuugugacucucuuucuccuguugggucauguccaacuuugauaugauacaaucuaccauaacaggggaagccaaagagagagacacugggggcccagcaggccgucuccgaggauagcauugcucugugauacagaaagagaaccugaaccuccaccagccuagacagauggacgagucccgucuccugcacuauuaucaaccccacaucugcaagugcuaacaggagcaccuuguacuugcuuuugcagucggcaucuccuuugcauugaaugaugggaauguuuguggugcaacacuccagaaagcuaaaguauuaacaugagagucaacgggaucguuuucuaauauaaaugagcacccagauaugccacgguuaucaaaauggcugcggcuuguucuguagcugucuacacaaugcauccuaauaaacugguccuguuuuguuuuguuuuguuuuuuuauagaagaaacuugcgcagcagacagagguaugucaccaugcuugggaaugugaaaugguauuguaaucagauacuggagucauguacacagugggguggggugcaggcagagaauguucuagguagagucuugacggaauuugcccauguggcagacagaaacauuaaggagguagccaggaacugaagacagagccagaaaacacaauggcagagacucaaaggccccucaaucccaaaguaaaauaaagcugauaggaauauaaacaggagcaaggacaugugcacugugcaagauuuuaucuuguaggaaacaaaacaacgaugagcggggcccggggaagggaaggaagaucugaaggggcaaaaucgaggcagagaggucgggagggaggccugagggcaccaaaguuggggcccaagacugugagaacaggcaggagaagaacaggauggaacaggaggcccacauagccaguuagauuaagaggcccuggugcagugcaggauuccagcugggagcgaucagaaugacaggcgaaaugagggcaagggcaggagucaggaguuaggaauggcuugugaggaaggcguuagaaccuucucucacucugcucccagagucuccaagaauagcccauccuaaacucaccugcucuucagaauagucaccugccuuguaacuuucucaaggugcuauagagccuaaagauugccugcaacacgcaggagucuggacacacacauucuaguucugucaacuggcugagguauaucucaaucuuguuuguugguauuggugguggugaugguuuugagacaguaucucuguacauaacuucuaacuguccuagaaucugcuaagaauaccaggcugggcuugaacucacagacauacgucugcuucagcauccccacugccaggauuaaagcacgccccacgaugccaucgcuaccuuaacuguaguuuuuuaugggccuuuugguuuguuuuuaucuuaauccuuucaacuugccaauuuuacuagagacuuaaaacacuacucaauaacaaagucugcuuaugccaggagugucuuuuuaauuuuugccaaugacaacaugcacuaacaauguguccuuucuaauuaaacacauggaaggaaauaguaccucaauguccugucaccacuaggaacugaucucccaagcaaggcauagcagcuugccggggucuucuuguaguuacuccuccaaaguaauuaaagcugguaaauagcaugucuccugugauuuuuugcauccuaagcuaagccagcucaaaugucacuuccaccucuaaggccauaccccgcgggugggcgcuguguagccucagaugguaccuccagugcuaggauuauguugccauuauuuaucauaaaaggauacuucugaguguagacacuugcagacauaacacacugagagguagcaggcucuccaaaauguaucaaaaguuguucaaaacccaagccaaaacaaaacaaccguccccucccccaaacccaacaaaccucauuaugaugaugaagcacagaagauuauauuguaaaagaaaccaaacuucagauagccagguaaagacuucgacguuaggacuucguauuuuuguaaacaauaaaguaaaagagaaugccauucucagaauacuagcccuugaugugggaggcuucuagaaccagguuaaaggggagagacacgggggaaagggcaaaucucucaacucuaugcugguuucaaugagauagucaccaucaaucuuggcuuuccauacuccguccccaguugguggcuggguggggagagugaguagguguauuagcagggggugggcacugaaguuucaaaagacuugcaguuagcacucucugcuugccacuuguggaacaagacgugaacucuuagcuguucuucagccaccugcccccaggucaaugcccagucacuguagacuccaaucuucugcagccauaaucccaaggaaacccuuucuuuaaaaguugccuccgucaaagcugcugccuguccuuggguauguucuccuagcugggcugccuugucuggccucaaugggagaggaagugccuagacucacagagacuugaagugccagggugaggaaggguugugggaggaggugacugggagggggugaccgggagggaacagcaagaaauauguaaagugaauaaguuaaaaaaaauuaaauuaauuaaaaaauagauuuugaauuucaaaacguuugauguuccuacauuuucauagacuuaagacuuaggauggcuaacauuguaguaugaagucuuauaguuuuaaaaaucagcauuuucucaucugucaugggacaaaccgaauucagagccguggaauuuguaaagcaaugaauaaaggagacaaacuuucaaaauaaaguuugccuuggucgugguauuuuaucacagcaauaaaaaaguaauuaauauagucccaaaaacauuuuuaagcccuacuuuuccccagagcaacaaaaaucaaagaaaaaaguacuucugaaauaaaugaaaguagggauaaugggaaugcagaaaagggcaucagaaaccccaacuacugucuuuuuacccaagaucgcaagcaaugugcauacacucuucuuauuuggguugggagagagagaaggucuugguacaguacagccgaccuuucucucucuccauacugccccagccucucaaguguuaagaucacacaugccugacacuaugcuuagcucuguacacacugcuagcccuaagacaucuuuaaagcuaaccuaaagugucacaauacauauuguugggguguuuuguccguuucucuggguauucuggcccuugguauacagacaagguaaccuuaaauuuccuaccugccucugucugcggggugccaggauuaaaggcauguaccacaacaccuggaaauaauauguguuuaauuauagugauucucugaugcucuugauauguaaccacugucacuggggucagaggccagugaggucuucaagguggcuuccucaaggaagcaaaaagguuguaaauauacauuaggacaguaaagugugguagauauauauuacuuuucgguuauccuucaaucuggcccuuuauguauuuuacgaacaaccaacucuguuuuuacauauaaauugauguguauacauauauacacauaauauacauguauauauuaugggaacuagcuauaauggcuucauugacaccuauuauguugguguuugagaaaaacacauuuauagcacaugaauagaauaaacaccauaaauguucuacuaauaaaauacuaaauaaaagacagaucugaaauacacaauacuuuccuuaaugcauuauuuuuaaaauggaaaguuaaaaguauuuuaaguaacuacagucagguauuaacauuuuguccaguaauaaacuagcuuaaaaguugaaacuaguuuuggucaacuuggcacaaacuggagauaccugggaagagggccccuuaauuaagaaauuggugccaucacauuggccuaggugcauuuucuuaauugcuaauugaugcaaggagcccaguucacugucagcagugccgucccuugucaagaacgguagcugagcauacgaggguaggcaagucagcgguguuucuccauggucucugcaucaguucuugccuccggacuucugccaggcuucccuccaugauggacugugacuuguaagucaacaaaccacugccuuccuagguugguuuugauccguuuuauuacgcuaacagaaaagcaaacuaaaacaaguggaauuauuacaaguauuuauaaucagcaccaaaacuaauuugucuuauuucagauuuaaaaagaaaacaaaaaccaaaaccgcaaggucuguuauagacuccauuuguuagaaaauacucucgcugucauuccuaaaucuccagugacagccucugagggauaacugcccggccucuuuggaggacagacacacuuacgaaacuacagaaaucagacacucaguuucucagccucucucuuucuaagaucuuagccaugugacugagacuggagcuuaaaggacuugccccccacccccaccccaccccacccuguuuccuuugcuuucagccugaggccggcacccauaggaagggagcuaaggaaaaagcagagccgcccauccuggcuucagagccacagacagcacaauucugccucgggaggaagugugucacuucuuacacugucugguuuucaggccuagagcaauucuaaaaggagucuccgaaguaaccuccaaauauaagaauguaguuugaugaauuuuacuguaauugaauagauuucauucacgugcggugaauucacauucacaaacagcucuaugcuacugcuucaggcacguuguucuaauacugcuugggucuccaguacuuccuuccguugcuaagcuaucucagauucugggaucaaacucagggcuuugcacauuaggcaggcauacuacuacaaccacacucucagacuugccuaaauguuguaaggcauuauuccuggggagacgugaacaagcaucuacuuaccccagacagggcaccaacaauggaucaaauugagaccaccaccaauguccaacucagugcacagaugaguuuuauugggguuacuuacaggaguaugggugaaaggagcuauuuacaggagcagaaaugacucaaagacagccacauuaccaaaagcccacuccaaauaaaagcugauaaaagcuggcaaccagaggcucauugccuggccagcaggcagcucaaccucucuuucuggcagcucugcuuuucugagagggucugaggaguccuaacugcugggggguggggggagccuagugccaucuggucaguuucagggacuuccugagucuuaaagagcuuccccgcuggagggaguguuucaaugggaaggaaacugcuacugguacaacaaucacuuuuaaucucccuagcucagcccaaacaacccaaaauccuuaggguaauuaacugcuuuuacuccagucagaguauuugaggauuaagauauacaaccuggaauaauuaauauggauuucugcuagcauucagucuaagccccgccccacaguuaccuggcaauauccagguaugccugacucacuauaaaaggggcuguuugaccccuucuugcucucuugccucuugucccuuucucccucucucuccacuugcucauggcccgccucuacuucucucuuuucucucucucucucucuuccuuccucccucccucucuuucucugccucuacuacccucuuaaguccacuccccauguccuuaauaaacccuauucuauacuauaucuuccuguggcuggucccuggggggcgggggaaaggggugcuucaccaugggcccacagaggcauccccuuucccccacgccggacuacaccaccauagaacauuuccccccucucguaaucuuuuuauaaacacaucaguuuacuuccagcuuagaaggaaagcugacugagaggggaggaguacuuauacucagaaguguauuucccuuacccucucugcgccaucauaaaacugggaccgaccuggugugccgugauaaaaaacugaaaauacacuuggcuuagcuuaauacucuugucaagaaauaacucuugacagaaacucgagacaacuagcgagaucauaccagacuuucaggauugcuuccugauccuccugacagucuucaccuaugugccacacaagaucgcuacaggacggccuuccuucuuccagcccuuacggaaaacagugacaucuugauucagugacacaccugucaguaacaauguaccacaaugcauaguggccugugcccuugucccaggcucugaacacggcuccuuucccagccucccucucucaccuauuugcucucacuguuugcucagaaauauugcacuuuuuuuccuuugaaggagccaccuguccucaccucucucagguuuucacgcuauucucuuuauauggaaggcacucaugaaacaccaggauaaaggugccaagagcugccugagggcccaggccacacccuagcaugguuagcugccuccugcccaauuauggguuugaggaaggccguggugggacuuaguccuggcuaucuucucagcaccaagccuugagucuggcauauggcacgugcccaacagauacuuauaugagacaugaacgaauugaucuugugaugugagaagcagguuagagucagaggaaaagcugguggcauuaagccaauaggaagccuuccagaaagcucccaccccucguuagcugcauggaccggucacugucaagucuuuugcuacugucucacuaacgggagccagugugggauagcagcucaauggugaggcaccugccuaggaugcagguggucccaggucccaucccaagcuccauccucaccccacagaagagcaagcuucacccuaaguuucugagggagggcggucgagugaaaacaaggaucaccuccaaggguggggucucgaguuuuuauaaccaguugucguggaucacugaggaugaauaauaaaauuagucauauuuggugaccagauaagaacaugaugucauaaagagaaauaagccaagaggguuaaugggacuugggagggagguaguuaagauuaauuuccaagugcaguagugcagcccagugcuggggagguucguggcaucugaggcccagagacuggagaacagaacauggggcugccguuuuauggcccugggaagcgaagacaaucauaggccaaguuacugguagagccaacgccaucuuuuccugcuacucuuggaauccaggucaggagccccaucacuaaggcaaccaacggaacuuccuugacuagggauauaaacaugucagugcucacaaggcuaauuagauaaagccaagcgcaaugaggucuucaaccaaguuuuagaaaaugucucugaccuuaaaaugauaggacgcugaugaacucuaaagagucuuacuagggguaaugaaaauuauuagaauuaaauucuuuaaguagucuuuuuaaaaaaugccaauuauuguuuuuacaauacuuuguucugcccuaugugccuaugugugcaugcaugcacuagugagcuuugugguauagaggccagaugucgcccucacaagccuuuugcauuaccucuccaccuuauuuuuguaaacaggguuucucccugagguuaaagcucaccaauuuggcuccacuggcugaccagccaaccccaggaauccuccugcaccagccuccccagcccugggggcacaggccaccccacuacaccuaacuuuuauaugggugcuagggauggaagccugaucuuuauguuugugugggaaacacugcaggaacugagcgaguccauuccucagccucagacucuuucgagaaacuuaacuuguuucaccuucaccccuaguuucuggugcugagagucagagcagcagucgcagcuggagaaaaaaaaaucuuuaagguaaaaaaucuaaacagaggucacagguuguguucccaucucuacuuacugugugcucuugggcaaguuaguucauguguccaggccgcagacuucccgguguaaaauacggugcacgcucacugcuaaguguguucuaggucuaaacauuaugacucucagcaaaaggauuuuagaauacuuauauaaacucagaaaauaauaugugaugaaaacaccacuauuagauaaacucuggucuuuaaagccuuaggucuuuugcucaaacuaccugcuucacaaaaauacuacagacaaucaaauguuaagccaucagccaguggaacaacgaaaccacuguugacucagcaaugguucgcacuguuaagacgacuggaauaaaggcuggguguguagagcaccagccaaacaugcagcagacccaguuccucccccagcaccuccuccacccagaggaggaggaaguagggaaccaugaaacucaaagaugcauuaaccuuacaaaggccagcaacuaaaacagauaccaaccucccaagucagugugaggcuaucaaagacuuccguagguuugcgucuggcuaaccuaccaucggaaagguaaccaagacuccacaacagugagagagggcaggguccggggcagaaagagccacuuuuggaugacacagugcccucagaccuucuuuuuuucugacuuuauuaugaaaaucuauucuucagaaaugucaccugucuucuaccuuagagcaggcccugcguuaguuuuaaaaauuaauauugagaguugcuuguauuuuggaacguggaaauuauuaacauaaagcacucuugcuuguauacauagggaggugggaugaacuggggaggcugagaaauaauagggugaaaauuguaugaaaaaaauuaauaagaauaguaauaauaauagagcacacuuuuuuuaccuuuuuauauauuuguaauauauuuuuauuuugaggguacgggcaauuaaagccaaggccucagcauccacugagcucccccauuggcccucaacuuuuauuuuaggacugaagggaaucacaguggcauuuggauugggcauagccccagcucuguucauuuaccuucagccaugagagcuagaaggaaaggccagccaacgcaaaugccaggccaaggcgaguuaugaaaugaggaagggaagcuggggagaaaaaaaaaaaaauauauauauauauauauauauauauauauauauauauauauauauauauauccagguuauccugcagggaaggcagaugccucugggaaaaugaaaagcugucagcugaauuaaaaaaaaaaaaucagcagggacagugaagagccaacugaaaaacaagaggugcacaggaaacacaugcgugacacagaaaaaucacgcaugaccacgaagcaagccuguugaaggcaacacacagcagccccaaucaagcauaaggagacuuaggccaucacacagugagaucgaccuaacucaccaccauugcaauccguagcaccugagcuugagcaggcaggcuuacagaugccgaagggacagacacaccaggaaugucucacguugggcacagaaugaaagguggcagcagcagcagcgucgcacacaaacaucagcagcaauagucuaugaccacaaguguuugcgcuaggaagacuuagaaaacuaagugugugguccacuuaccggcccuccacaagcauuggggugauuuuagggauguuuguaauguggggcucuuuuccuauucccuauccauucuagugagaaucugaaaaacuguaaaacaaaaccacagaaacaaccggcuccuuucucagugcaaagagaaauccugucucaaugugcucauagccuauuuccaaaaaucaguugaagauaggugugaauuaacagguguucaguuuuuguuugguuuuuuuuuuuacagauuugguggcagaggagagcgccagaaaguuccaaggcaaccauccugcaucgguaaacacagacaagccuacagcugccggcacacaacuaaaguacccuccugcccaacacaggagauuaccgcuccuuguaaccagucaagccucuccuuaaagagggcuuuagugcccaauuaugucuccauagaaaccugagaagcaugagcaaguucaucagcauaucuccgaccuccccuccccgcgcgcggugcugagcagaccugugcaggaccaaccuguguggaaaaugacaguguuuuuccugagccccgaaggaagccggagguuucgaagcaguccuuuggcgguuaggcggacguggaugguggauaaggagaauuugggagacaacagcaugucuucgaagccagugggagaacuucgcaggggaagcagcuuuuccagggaccaucacauacugugucucuuggcaacucgggguucuuccaggccaagagauacagccagagaaaaacaagcuuacaugcuaaugccaggccacccagauuggggggugcguggggggggggguagcuagaguuagcuaucccagagcuccaggcuuccguuugcucuuccagauguugcuaacaaacaaugcccuucgucugagcaagaucugugaggagcagcucaggaagcaagcagccugaauuacaucacacugugcaugccgcggguuguugugguucccgacugggauggaaaggggaggagaaaguggguggucucgggagcuuuauguaacagccaaugaugucgcagguccugucacuauuuggaacggggcgaaaugaaauaaaccaccucacaugccuaaugucuauuuauuagcuaggcuaaauaaagaaagaaagaaauaagacuucauuagagcaaucggugaaccgauuccauugcuuuuuaacugcacagggucacacuauuaucccugggcacuuucccaggugcuuuaccuagauauacauaaaccucauuacuuggaugaaaaacacgccaacagagcgaaacccucaagcaacaaauacuuccaaucuuuaaaauaaacagcauuuuuuuuuuuuuacugugcuaaugacagguugucaaauugucaacucuaauucucauguauugagagccacacuaaaaacgaaaaguuagcccuguaccaggucugcugcuucugagacucgguaaacaauaucacaaggcaacaaaccuuacuccauuaacagcucacuagauguuaaaaacccauucagaaaucccacacagcauccgagaauccgaggggacaggagaagaggagaacugaagcaacucacccccuugcucacaccccaugccuuguccugucagaggauggcaacccacagagggucacuguggggcugagcgagcacacccacacccaaccaaccuccugaaugaacaccucccugcuaacagaaccagcaacaacaauggaauuacuauagcuugauacaguuccucaugcugggccccccaaaccauaaaacuguuuucauugcuacuugauaacuguaauuuugcuacuguuaugaaucuuaacauuuucccauggucuuuggcgauccccgucagagggucacaccacugaauuaagagucaaagaaacagacguuccagcuuugauuuccucuguuagaucacagguuguuauuuuuaaaacuguuaaaaacaccuguccccaaauucugaauauuaaaaacaaaaaaccacaagcucucccuaugcuaucaaaauuacgguuaaaaagguaucagugagacucaaaauuauaaacugaaugagaaauaagauuggugucacaaauagacacaccacuguccacauaguccgauuuugguuucugggugggcucuuuuuucagggguugggguuguuuuuguuaacaguaaacuauucugucacaaagaaauccacuagcuuacacuacccaaaggaagaaauaaccaauccagucaccaaucagguacguuuacuaaaaauuucauuuuaacgggcuuaagagaaggcuuggcagguaacagcuagacuuccagaggacccguguucaguucccagcaccuacuugacagcuuacaaucaucuccagucccacccuuucaugcacgcaugugauaaacagacaugcauguaagcaaaacacccacacacauagaauaaaauaaauuuacaauuaaaaaaauaaauaaauuuaagauaagaaaaguuuauuugaacuccacuaucauuaccuaucccaugcacauuaaauauuagccguuuucccuaagugcagaaagaagcugaaauaaugcaaauaauaccaguguaaaggaaaaccaaauguagcuccuguuugaaaaacaaaacaaaaaaacaaaaaaacaaaaaaacaacaacaacaacaaaaaacuccucccaaccaacaaacugugcuuagguacaagcuucaaacggcucagcuucaguucuuucccaagcaucaucugcccccugguggccaccuggcaugagugcaacaaagaggaaaggugucugcuguuacuuuguaacguccuaaggaucagcauaaggcaaagaccacagaaaaccagugaagcaaaguuugguugguuacauaaggaggagccguucaaaaggaauagacuuuaguuggcuuuugguaguguugagucuuuugguuuuguguuguuguuguuguuguuguuuguugugugugucaucucuguucauuauagcaagaacacaauaucuacccucaacaaaauuuaagccuaugcuacuuacuguuaacuaugccguaacuguacguguuguaacaacguccugaucuuucaaaacugcaaucucucaacagcagcuucccauuuccuggccagcagcaccagugccgagaagccauuacauauuacgcugcuacgagucucacagcuuuagauuaccaaaaguaaucggagucagcaagacuccuuucucccuucugugcuuguuauguccgugcgaucgugccugugagugccacaugugccacacugugcguggagaggcuaggggacgaccaucaguuaucagacuuuugacaucuauuguuugggauagucugucacccuuuuggcugcguccaccaggguaccuuggccccgagucugcagagacucugcgucuccccucccaauuuccaucccccaacagcagauuacagauaacccgaaguaccuuguccuaugguuucacagcaaguaccuuuaccacccagccaucuccuuggccccauuuacuuuguuuguaucguacugugacuaauauuccauugcauagauacaucacauuuucuuuaccuacagauauguaagcuauucuuacaucaguuauggugagaaugcugcauaccuggcagaucaaagcuccuuccacacccugacuccucuuugguaagucagcccucauugggauauggcuucuagacagucccuucaucucguaggccaccuaccaugcuaccgacggucacccuggcuaagcagaagaguuggggagucccacauguccaauuuugcuugccacaggcuucuguaucaaucuaagaaaucacggacaacgacaaagccaugaaacgcuccccuucugccucuccuccugagguuuuugggcuucgagucuuauuuuaauucauuuugaguuguuuacuguguaugaggugagaugaaggcuggaguucgcugcacccacagacaucuaauucuccucacgcuaucucuuggagagaggacgguucugcuugguauuuucgucagucuugccagguucagcggacuguaaguccacagguuuguuucugggcugucccauucauugcacuggucuauguaucuaccuucauacccauuucagacuguuuuaauuacagacuugaaagcaagaauuaugguaccaucgccuuuguuuuuccgcccacaagauuguuuuuggcuaccuuggacucuuauuugguuccccaugaauuucacauagugacuucucuuucucaguuaaaaaaaaugcaauaaggauguugacagaggugacucaagacaauaggcccuuuuagcaucuacucugaggcugguucugucuugcuaguuuucgagagugcuacacagagcaaauguaguaacauugucuggcuuuguucuuacuacuguuugucaugauuuaacaaaaggaagcucaaaccaugugcugucacaauuauuaaucucuauuguuauaugcauguuacuggaaggccuucuauacucaggucuauauucauggugcuuuuuuuucauuucuacacuuacaacuuuucuauguagaacacauucaugugcccugggugaagagaucuaguucucagccaaaaagguagccacuguugcagugggauucaccaagugauccauucuucguaacgcucaguaccaaauuuuccauguauccagaugguaucggcccuuucaacacgagagcaaaguugagaucaccaaugcauaagaaggaaagacagcaggugcacaguguggcggcaucucaucuccuccccagaguaggucugcagcucucaaccaccucccgacauuggagaaaggagauguagaaagccacacgaccccaggccauguuuaugaaauggcacagauggagcagguguguuccugcucccagggcagacaccauggcaccuggcagggaugaucuauaaaggaguccacggacuggguaaacacaacuugggaugccugagauauccccaagagcaacuaugagugucggagccacgguaaaugcuguggguaugacaacuuccucauaaacagcaggcacguuuuauuuagagccaguguugccuagaauuccauaguguaauacccuuuaaauaaaccacaccggcuagaccucuggaaggugguucauagccucaguggguuuccccacuugcuuugaggguuuccuagaacacaucagggugggauuggggaggcgccuucaauguaaagccaugaaaagcgaucaacaagaaguacuguuagccucgauagcaguagcagcaggggcagcuaccaugugagagcuagggaugaaaauagucuacacggucaaacccauucccacacugggauuuaucuccugaacauucccgugcagccagacgagaaacucaagcccuggagaggcuuagcaaguagccagaggucaggacggaaauagagaggaggagaaucaagauuuacaccaacguccgagccgcacaaggucacagcuucuucauugucuucggagguaacagaauuucuuuacaauaacuguuaaacuaaaauaaugauggaaauuuucaaauauuauuucauacacuccccccucacccacucccgaaaaaaaaaaaaaaccccucaaucaggggcuggagagauggcucacagauuaaacgcauuacuggggaacaggguucaguucccagaaccuacaugggagcucacaacuaacuucagauccaggggaugugacacuguucuuuggccuuccaggguacugaaugcaugugguacacuggcagacauucaggcaaaacacacauuaaaaaaaauagucuuuacaacauuaaauaaaauacauaaaauaucuuaaaaaucaaucaaucaaucaaucaaucaaucaaucaaucagcgauuggccagcauauggccagugcuucuauauuguggaucauaucagaaacuaguaugaagcuuuuugaaaauaauaugauuauccaagcaacuauacaacgcaugugcgcuccacucugaaguagccgucacaagaaaacuucgcaaacguugacagaaaugauugcaaaacaacucauaaugcaaucacugugaaugugacagagaaccaacucgaauagccaagaggcucaaugcuaucacacuuacacugggugacccauuaaagcugaucacuccacggcauguaacaaaaaggaaugucaauaguuccaagcaggguugcuucaaaagccacacaggggaaguuuuccucaguaggcucaaacuaauuccaggcccaccuugaguugugaaacuaacugacaugcguacagccggguaggaacccacagcucaugguugaauucugugcugacaaugugagauccuguauaacagagacuuuacacgcuguaacguggccuuucuuuuuucuggcuuucugcugugaugugcaaugggagccaugugacuuauacuagcacuguaauaaaaaaugagaaccuguaggcagugcauggcuggcugcauacaguccugcgugucauacagagaaacgucaaugaauacauuuuacaagaucuuuagaucccccaaaggaaguauuagacaguguaguugaauggcuuuaaguuauaggcugucuuagaaauguccgaccaagaauguguaugggggaagucagaaacauagaacuaacuguugaguuaguacaagaaguuaaaaguuauaccuuaagaccauuuuacaauuaaagaugaucugauuuaaaauaacacauuuggagaaguauccaguuuuauuucacaugaaccauauuuuaaaaaucaguuuaaguuaauuugaucuguauaacaagaugucauccucuguguuagauggcucaacaaaucaugcugcccaaaugcccaugucauagcagcuaguuacaccuuaaauccugaauuucgacuuagaacuauaccagcaaaaguaauuacaaauaaauuucaguauguuuaaucauuacuuuucaaauaaaaauauuuuaauauauucauaaaguggccacuuaccugaauuaaaagcuguaaacagacucuuccuugaaggaccuagaaugggacagaaauauaaacacacacuuuauuggaaaugcuaggcaaaucucuaguuaucuuguaaauagcagugauuucauuuucuaaaagcccuccuuuaaccucuaaauuuuagguuacagcuauccacugagaaaauuccaacauauaaacaacuugaucaaguacacuuuuucaaauauagacaauauaguaucuaauucguaguaagacugguaagaauuaaucaucaaaacacagcaucaauuuuaaaaagacaaagcgugguauauuuuguagucgagggcaauuaaagcucauuuuaaauuuuaauuaauuuauuuauuguuuauucuagugucugaauccagggcccacagauuggggagaaaacuccaccauugaacuauacuccagccaaaaggaggcccaucucuuagcuugugcuuucacucuucuucugcacacaggaaacaggcuacacuuugugaaagagggaugcuggugugugcccucccaaggcugugaaggagaauacacuagagauguuucuccaagcugaugcaauauaaaaugcagccaggaaccauacagguagacauuggaagagcuauaagcacccgugcucgacauccaauacucaucaagugacuaaccaucuguagaagacugguuggaggacuggugagguggcucagugguuaagagcgccgacugcucuuucaaagguccugaguucaaaucccagcaaccacaugguggcucacaaccauccguaacgaaaucugaugcccucuucuggagugucugaagacaguguacuuacauauaauaaauaaauaaguaaaauauuaaaaaaaaaaagaagaagaagaagaagagggagaagaagaaggagaagaagaaggcggcugguuggaacagccagagaccaucugcaggacuuuaggaagaagaucaucucccuuuacaaguauguagccaucauaaagagaccuccacaagaugcauaugucaaccuuagggcuuucaggaguucggcauguccuguuuugcagucauuggugggggucucuaguucucugaaaaucaccucaagaucaaagcuccaugaacggggguuuauuuuuaguuacuguggggguaguaugggguuuuaaaaaucaugauuaaaaaccucaguuucagauauuaccgccaucuuagcaggggauaaucugaugcuucagagcuguguguaagacaaauaagacccuaauggcacaguaaauaauuuucccccaacaggauucgauccacccuguauuuuugcuuuucuccuuuaacccaguagaaagaaaaaagugggcuggagaaucggcucggggguuaagagcacugauugcucucccagagguuccgaguucaaaucccagcaaccugaacaccaguucuucuuguuagugucuccggacaucucugcucuaccagcuauuuucugagauuuauuucuuauuuuaugagauggguguuuugcguguguguguggggggguggggggguaccugugcagcccaacagaaagagcaucagacuccccagaacuggaauuacaggugguuguuagccacuauaugggugcucaaaauugaaccuggguccuuugcgagaccagucaguguucuuaaccgcugagucaccucucuagccucucuacauguugauuuuuacuauugggcuccaucugucuauagaauuuggaauucuuggggaaugagaacaucucauuguuaacauuuauuuuauuuucuuacucacacccaguguuuaaauauauaauuguuaaauguaccauaagccuaguugucaaaauuuaaccuccugaaagccaaugaguuuaaaaguauuccuucuaaucacaacaaagacaauaccuuuuggagaaguuuugagcaagugcgagugagcucuggguaccaaaggcuucagauacaaggguccugacccauucugaaaugcuuguuugggagguuucucuucauauuuguugauggcagcaugaccaccuauaacaaaauggaaaagaacaucuuauuuaguacagaaauacaauagcagccccuaauauuuguuccaaagagacuacaauuugauaacaauuaccaagugccaagaaugcagaggcaguuacuggccucaaguaugaaaaauaaauguucccagaaugcaaaagcaaacacaaacaaaauaauacauuuuguuccugggcaauuuaugcacauuuccagcuuggcauuuuaucccagagagguggaagauaaauggccacccaugcugccuaauaaacauuccuaguacauacacagguaagcauuucucucacggaagacaauacagacuguaagcagccaaugcuaaugaagagaagagaagagaagagaagagaagagaagagaagagaagagaagagaagagaagagaagagaagagaagagaagagaagagaagagaagagaagagaagagaagagaagagaagaauaaucagagaaaauccucaguggcuucaagaguaagaucugguauuucagagcuagacugucagcauccacuguguuauacagguacucaaccucaaacugaaaaaacacagaaagagucucaccuaagcaaugaaaaccaccuauaagaaaacacaaaguuuccuaaagacacuaaagaaccugaccuauuuucucuaagauccugccaacacauaauucuagguauccacuuuuaaucuaccauauaauaaauaaaucauaauuucuuucugguacagaaugccccacaugaaugaauuaugugucacucugguucaggagccauguuagcaucccuguauugcuuugauuuuagucuaugcacugugaagcaagaguauaaauuaccaacuucauacaugccucuuguucacaaauuaucaacgugaacauagauguuuuucacuaggcuaaaugaccucauccccaccaacacugcacacacacacacacacacacacacacacacacacacacacacacacaggcuuuccuggcccucacccagcaucugugcacugagccaucuguuaacuccccuuauaccuggacaauuuuccuaauauuagaucaacacaaauccacccuccugcuagcaagcuucuacccaguuccuguccucauuucugauucucaccuugcuuagaacuaagggaacagggcuuuccaaacuuggcagcacguuagcugacaugauggucuaauauucgacaucacauucuaaaggacacaugggacaacggugucaaccuuucagaguguguauuuuaagauacucaugagaugugggcauuggauugcaguaggugcuuaacagacuugaauccaauccaagggaguuccuuuuguuauuacaguuggauuuuagacuugcucuucuuagagcaacuuugguuauacucagcagcgagguaagucaauuguucuaacuuugaaaaauuaaacccagcucaguuuaugaacaggacauaagauugccccgaagucuggaugcaugcuucacuuucugaaccuuacucacacaggguucucgcucacaaagaacuuagugaucgaauuccucacugacacgaaggaggcccccagcuacuggccucauaccacaggagacacugacuuggaagaaaucuaccugagugguucucucgagggcucacuauggcaacagaucuagcaccagauuccaucaacuucugaacacaccagagucaauauccauaucucaaggauaaaagacacugggcucagauacauauguauguguguguauacacacauauauauguauauauuuacauucuuagacauaauuacauauuuauaugaaauauguguuaaauauucauacuccaugauuauccauuguaugaucacccaacuuuaccagcuguaauaagcugaacacacuuuuaugaccuaacacauaagcauucucuccguuuucuaagcacauuccucuuggcuggcacacugcuuuucacuaaguuccaacuugaagacugacuacgccagggccaagaagugggagugaguggguaggggagcagggcagggggagaguauagggaacuuuugugauagcauuugaaauguaaauaaagaaaauaucuaauaaaaaaagaagaagaagaaaacugacuacuacaaugaggcaggaggcccucgaagcguuucuccuuccuuccuacucagcuccuagcauugugguuggcccagaauccugucgauuuccaacuguugccucacucagagcugccuauuacaauggucucuugguuaugcuacaauggguuuuucuaaaaucccuauuuucauauccccagaccagggaauguugcaaguggaauaagaagcggagaagacaggacguggagagagaaugcguugaacguuucagaaaauucuaggcagaagaaggaauuugcccacucuaaagaguuucucucuucggucucaacguuggcuugugagcuagcaugucuuaauacauucuggcaucuaguuaaaugaguuuuuguuuuuauuaaacucccuguaucugcacagaaauaaaaacuccgauuucugaaacucuuuguacaucagcuuaacgcucugcucugcgccgaucgucugccuaccuggcuuuaagacaaaucacugacaucuaaaguucaaaagcaaaaaaaaucacaagaaugucucauaugccccacauagagauacuaaaagagaacaggcaagacuaagaguuaucugaauauuuccucaugaaguaaucccuucagacgguaugcacucuaacaugccucagaagauggagacagcacuauccgcugcccaccucucucuauucaccugugacagacaucacuaaucaaauacccuuuuucucugaaccuggaggcagccaaaagagucaauugguucuuaucgacugcccaguguugacagauaugaccauacucacuaaccacuuuugccacaagagaaacaaaacugagugucaggaagacucauccuuucugcccacuuaguugggcaaaccgaagcgcuuuccuuccaagagacagggcggcaccaugguacugcggugaagaaaaggagucaggugcauacggcuggaaggaugcugaccgugguccaggucucccuucccguucaucagguuuaagauuugccguggauuaauagaaaccagaacaagccccaggugaguaguacccuuuccugucacuuccugucagccaggcugccacccaagugcaggagaggauggcccauuucuuuauuaaucuuuuggaucuccuauugcggauggagugcaagcaaacagcuuugguuggcaucucugccauugccccacaccaucugucuguccucaaaaauaaacaugcuuuuguggccaaagggaaaggggaaggaaaucucuggucuccauaguccugcuaauguggcaaaacuacuuucucaagaccugcuuccaaauugcacaaugaucucucucauuugguauagaaaaaccacugcacaaucuuuacacggauaucuucauacuaauuuuuccuauguacucauuaaaaaaaaaauaaaaccugagaaacccucagauauaagaaaaauugccuuauacgccuccuuucaaccaacuuauaacucgaaaacauuguuucuaaggauccccaaguaccaaggaccaggugccaauuucccaacagcacugugcaguggauuucuuaacagacaccacuaacaauacaacaucacaaagcaaaaggaagcaaaggaggcaaguguggccccucacagaggcuccaguguuggagcugucagucaugauaugccagcuaaagauuaagugaccccuccauaacagcagcaagaugauuuugguucaaaaugauuuuuuuuauaucuuaaggcaguuuaaaaaaaaacgcauacacauuuaacacuauuaugugaauuguauauuaauuauaacugaagacaacaaaaaaaaaaucugacccuuucauuuaaauccuaaggaaauauuuuucuacaucugccagucacacacucaaaacuuaguauuuagucagaaauuaaaucaucaaacagccuuuuaaucagaaauuaaaucaucaaauggucuuugguaauaggauaacaucauaccaagaacauugauaagcugaauuauaauugguuuaagcacccaaccccagaaaacacacaauaaaauuuguucccaacagauccauucacaucuuaaauauauauaaauacaaucacgaaacaccacagucaacauaaauugcaagcaacaacaaagcuaauaaccaagcgggccuaaaaaaucaauuuauuuaauaaaaauuuaagcaugcuuacaaagcaaagaaucagaugagaaaccgucgaccuacuuuuuuuccuaguaagcguggcuaacaaaggaauuauacaaaggcuguaggaucccacgacaagcagugccaguaagguagcaucauacugccuuucugagccggccgggggugugaguguagaauugauaaagaucguugaagaaauaucaguuucuguacaacugcgaaauccuccugguauagucauuuaaaaaggaacaaagcaagcucaggcaggaaaagcugcagccauguucaugcaucccucaugcuugcucccagucaauuagaauggggagggggagagcuguaagccgccaggcacuacacggaacagauuaaaccagcugcacgacagacuaagaaagacuggcagacgugcacgcuuaaucuguaagggggacgcauggccacuagacaggcucugcggguacacggggaaacccuuuuguuaacagacaaaaagaaaggacaaaagcauuucgaaaccuccuuggcagggucagacaggcuacuggggcaguggccaguucaacauggcuguucgauagaaaacccagggugugauauuauggaaugugucugcuccgagugucacaaacuccaucauuauggcuuucaggguuuucuggugauucuaucagggugguuuguuuuguuuuguucuguuuuuguuuuuguucuuuuaauuugcacaguaggacaaagaagucuagaugggagacgaauucacaauaauaacaaaugcuagucauauuuucagguucacagagaauuaauuaccuguuagcauaaacccuuugggguuuucccccaccccuuuaaaauuuuaaacaaugaauacauacaaaaauaauaacccucuuuaauuuuaauuaacauacuaauacuaugugccuaugagaccagccucugcauucagugaccugucugaaauggguccuuugccauuaacucaaugccuauugucuauaauccauccugucacauacuugcugugugacuuugaucugguaauagucucugagccucaguuaagucuccuaaaaguccaagguaaagaccaagguauugggguggaagcaguggaguagcggagcguguacguguaugguagcucuguugcuggucuacaccuaaagaguuugaugacucuggccccccacaccaccccaccccaccccccacacaaaugacaugcauuugucguuaaagcaaagagcucacaucuccaacucuuccucacaaauguauauaaucugucucuuucuccuaaucugcuuuuuauuauucauaaggcuauuucucugucaccuauaucccucccuguaccuauuaugauccuaggcacagugggcccuccaaaguuguuugucuuaacucauucauggauuauuucgugaggaaauuugagaagaaaggggggaacaaaacaaaaagcucucuucugaaugcaucuuuugaauaaagggggagaagucuuuuuggggggaaaaaagagcuuagcuucuuugcucacucggcaugaagaaaauggaaugcacaaaaccuuucagaguauuccccugaguuuaacuuauuuaugauuaagcuuaaagcuguauaauuuguaccacccuguggcuggcaucuaaagcagaaguuuacaaagcacuuccacaagacacucuuucgaaaaccaaaccaaacuaaaccagugaugguuuucuggaucucaagcuggaagagccccagcuacuauucuuuuccaaacagcccugcaaacaugucagcuggaauaauguacuuuaaguuccuuuauauagcaccugccaguaauacguaaccauuucaggguucccuggagguucguucaaagaaaucuauuccuaaaaacuuguuuccaugucaaacauucugaguaauuacaaagaaacaauauguaaaauucccacuaagauacagagacaaaauuaauuauuuguggaccauuggcuuugccuaugucuacugucucaaccacccacaaaaggugacaucagucugacuuacagucacugcuguaggcgcucaggucgcugugggugcuggccacugaccgggugcuuccugcccugcauaucaaggaugcuucggauauaggaaguggucuaggcaaauucacccaagaagagagugcaguuuucaagcacggaggcuuuccuugggauuaaaaaaaaaaaaaaaaaagguuucuaucuaucgugaaaacuuguacuuuaagcugguacauucaaacuucucuaccgaccauggaguugucagaaugcaaaauuaauguucaacgcuaugaugcuucagaugagagagacacaaaagccgcacacacacuuacuucuuuugaauaauucagaagcagaagagaggaaaugaugaagcaauuaggcuaugagaaguguggccucaaguaauuaacucacacaucucugaugugcaagaaggaugagggaaaagaaaaaaaacauuaagaaagaagccuuugguaaaaccgugaucaaagcagaaacgaucagaugugauaccuuucccuuuaacacuaaaauaagcagacugcucuguuagcacaugagguggccauauuuaaaaagaaauagacgaaaauuuaaaagcacucaaagcaaaaaaaucacgguugggagaaagcuuucacuaaauaaaaaaaaugcucggagcugaacagcagguggcgcuaugcucauuuuuuuccccaccccguuccuguuucaucuuuccaguugauuugccaaacuugaugugaggaaugcuguucacucaaauuucuaaaacugcguugcuggaaacaaacaaacaaacaaaggcauacauacuugccaaacaauuguuuuggucagaacucuucaaacucgcucaccucuugagcagucuauuugaugugcuuuaugcucuacucaaggacuuaguggagacugaaccucaauuccacaagcuccgccccauccucuuucugaagaccagauccacucacacugaauuccucauuguguuucaacaacgugggugcucuggcuuccucucgcuucccuuucauuaggcaaucuucaaaucacugggaccaugccuguaucaucuccggauauccuggcaccgaguggcccuaugcgagcuaugcugguagcaucacugcccuagagugcaucaaggguuggaaagaccuuugacaaaaaugaugcugucacauuuuaccaauggcagacaaauaaggugacgguggcaaaauguuacguucacugguuuguccccagcacaugacagaacacuuaccuagcaugcacgaggcccuggguucaaggcccgguaccuugaaaaaaaaaaauccauuaaaucuaagcuaagcuguucagaauucuggcuucuucucaagccaccccugccaggucaggcuucccccuugcuggucuggcuuuugcucauaccuccuacuggcuuccugagcuugauugaucuggguggagacuccgagagcagaggcauucccaauccaacucuguuccuuggacuuuacaaagcaaggagcugcaacaggugucugcugaaaucaguguccuucccaugccaugaguaaaugacucauuuuguuaaaacacucucucucuccaucuauaccaagacauuuaaucgcccauuuuacaaggcaauuugacucuuuaagucuauuaauuaaauacaaguccuuacuaacaggcacagcaaguguuacauguucaaacacccauuccgcuuucacuucucgugccaacccuuuucacuggcuuuagguggaauggaaaagcagaucuuuagaauacaaauuuaucaaacugcuacccugucggaaaaaaaaaaaaaaaaaaaaaccauccagauggagucaacuccaaaaucaaagguccggggaucaaauuuucugggucacagcuacaaugaagucaaaaccuagcaagcuuaggagauacaggauuccuuggaaaggugugcuuccugguacugccucuggaaacaccauagacuuccagaucuuucaagugugccuccagagaccuacaccaugcucacuaacgcacagccugcccagaagcacacgcgcccauacucggucaccagccccuuaccugcccuagcccgcauuccuuaggaagguuccaagggaacucuugaucucccaacccacccacccucucccuuccaccuauuucaccaaaagcuuaacuuugaaaagcagagucuugcucuguugcccagcuuccugggcucaagcaauccuccugcuucacacacacacacacaauuuucauaugcacuguaggcugggauuugcauaugaggaaguucgugugauucuuuucugaguuugggugaccucaguauauuuugugacuccauccauuuuucugggaguuucaagauuucacuuuucuuuacagcugaauaauauucaauaauauauaguaccacacuuuccuuaucugucuguugauagacauaucuagguugauucuccuuccucgcuguugugaauagcgcgguaauaaaacauggucucucuaguagaguguggaauucuccaaguaugugcccaggaguggaauagcugggacacagggcaguucuauuauuauuuuuacaaacuuccaaacugauuuccaaauaauguauugauuugcggucccacauacaauaagugggaauuucuccaaauccccaccaacacuuaacagguuucuucacaccagccauucugacugaaguaagacuguaucucagaguagucuuaauugauauucuucugaugauuagggauauugaacacuuaaauaauuagucuucugugugucuucuaagaaguguucauccugucaaauuagcaguauuauuuccccgguguuuaauuuuugcaguucauuagagauaagccuccugucuagaguguaggugguaaagauauccucccauucugugagcuguuugacccacagucgauggcuucuuucacugugcauaaacguuuuaaucucaagaaaucccauuuguugauucuuggcccugguuccuguguuaccgcgcucuguucagaaauggguggcucaccccuaugucuuuucucugacaacuucacauuaugaauuaagagcuuuugaucuacuuuggguugauuuuuguacagaccuaacgucacucuucggcagaugggcaucuuaagauuugucaacaucauuuguugaaaaggcuuuuuuuccacugcaguguuuuugugauuccuucaacaaaaauuaggcuccacccucccugcuuauuuacagauccucgguccuauuccguuaguuuaagggcauauucucauacugagcugucuuugucauucuagcuccgcuuuauaauuugagguuaagaucaugacacuuccagccauguuccuuggcuccuuuggguugcuuugguuauucguggucuuuuuuaaguuccaaaugaauuauggcuauuuaauucuuagccugugaaauaggacauuggaauuuugauggcuauuacgauacauauguacauucacuuuuguaauuauaaccguuuacacaauauuaguucaaguucaagagcgcgaaagaagaaaaauaucacacaggaaguuuaaauuuauaauaaaacaguugcagaaaaacauacugcaguauaaugggaguaucguggggucugccaagauugaguguacuagaaaaggcgugggugagaagaucuccauucccucaucauuagcauuuaaacauuuauugguauggauuuucucuagauggcgagcacaguuaacaaugaaaagucauaaaugcagaagucaauggggaccacauucaaacgcacgacucccaguacaaaguggauccggcaaccaagaaaggagaaacuggacagacaagguagauuccaguagcugugugaguccaucugcaagcaguagcucaucauccacccuuuuauuucacucaagaaggacacuaagucaaugccuacauucauagcuuguaucugguuauuaugaagacagccauuuuacuaguggaaagucaugauuuccuaagagguauguuuccuagggcuggaaaugaaagccaaagaaugagcuccccaauggcccuccuuugucuuccccuucuaugaaauacuuuauucuccaagagaaagcuccagggccuuugacggugcauugccagucucccagugcugacucagccuacucuaaggaaaggccugggaaagguaagugaguccacacugcaagagagaagcaccuucaaaggaaugacagcaauucccggagccacaaaacaucuaccagccaaagugauuucccaucucugaacuaucaagcagacaugaacagggacuuaacaaagcugugagaggcuuuucaacaucaucauaaagcauaucacaguucacauuugauaaaauguauggcuugcauaaaugagauucaguuauaugagagagagagagagagagagagaucaggggaggcaggagagaacgagauugggggaagaagaaagaaagguagaaagaaugagaaucuacuacaauguuaccuaaaauggacaacacagaccacucuuuuaaaaauaucugggcuaugaaaucacaugggaguguguauuauacaaguguuuacuugcugagccaggaagguaacuugcaaaaaaaaaaaagcgaucacaaaagcacaggccuguguaucugaaacaucugacaaaaguuugcaaagaaaaguguaacuaggaaagucacuguggcccaugacacagcgccuggugcucuggaggguccauucuuagugggaccgcagauggcaggguaaagaaaagagcaacaauguuggagaugugguuauuucacaacugggaaagagaugccacuaaacgccagaugggaacuuuaaaccugaacuuugguagugaauauaguggagagauggagagaggcauggauggcucucaguauuugaauuagaauuuugaucacaugguagaagacaggccuuguccaaagggaagaguagagaaauggaguagagauuaggaggcaggcauacuugccugagcaaaggguaugggaauuuucucuagaccaugaggaggugacugaggucacuugguaacauuuaauuauuaauaaggugggcaaucagcagggacacucaggaagauaaagugcuaaaugaaugugggguucaaacaaaagauaacccuguuauagcuaugguuauaaugucagcucuuuacaugcaacuacauaaaaagaccuuuauagaaauuaucuacaguaacuaggaauuagaaaauuaaaguaaaacccaaagcaguaacaaauuguacuauucucaaaaugacagcuguauauucaauugcaauuaacucuaaugggccaaaugcuuucauuagcaauguacaucuaauaaauuaguuucauuggagaguacuguaauauuaaauguucuucaaauaaaaacaauaggcuacuuauaaauaaacuuauaaacuaaagaacaguuuuuguguuuguuggaaaaaaccuuuuuaaauggucuuuuagagccgggcggugguggugcacaccuuuaaucccaguacuugggaggcagaggcaggugaauuucugaguucgaggccagccuggucuacagagugaguuccaggacagccaaggcuauacagagaaacccugucucgaaaaaacaaaaaaacaaacaaacaaaaaaaaaacccaacccccccaaacaaaacaaaaaaaggucuuuuagcaacaaaaguuauacacauggacaaauauauacauauacccuguucuuuccaaauucacccaagauagauuugaaugugaauacaggcuaacuuuccccaaaauuaauauuauacucuaaugcuauuuuaaagugaucuauuuuuaaaauggugcuaagaaaaaauuuuuuaaauuuuaauaauuaagguccaaauagcuuuaaaauucuagaagagagagagagagagagagagagagagagaaaagaccaugacucaaccgcaaaucauccaagcaauuaaauuuaaagauaggcaaaggacuuagagacaucuccacagaagguacacggguggucaauaggcaugcaccaagaugcaagccacucagcauccuuaugcacuggagaaaugcaaaugcaaacacugagaaacagccucacacccacuaggaugaccaggauaaaacaucaaacacuggugagcauguagagcuauuaccuuugugaauacaaaccagggaguagccacugcacagcauagcaugaagaguuccucaaaaaacauuaaaucuauuuaccauaccauccugcaaccucauaucuagaugagaacccagaagaggugaaagccggggauuuaccauauguaacaccaugguagccacugugcaccauagcaugaagaguuccucaaaaacauuaaaucuauuuaccauaccauccugcaaccucauaucuagaugagaacccagaagaggugaaagccggggauuuaccauauguaacacccauguuagcagcaggaauagucaugguaacccaaaugcggaagccaccaaaguauucaugggcagauguguucaucugguguagacagacauaggagggauuauuauucagccuuagaaagcaaggaaauguugacaaggacacaaugugaauuagguugacgacaugaugcuaagccucauuaaguuaaucacaaaggaaaauucucgcaugauuagccuucggugagcuucguggaacauguaaagucauagggacagaaagaaucaggccaauugccaaagggugggagaaagggagacuuaggaaguaagguuuagauuuuuaauggacuaaucagagcaggcaaauguuugagaaacaggaauggcggcuccacacugcucuaaugggaauguacucaacacuacaggaucuaucuaugcagagcauuuucaucauuaaaaaccaaagcuuucuauauuguaauugacacacagcuauacagauuaauauauuuauauaugaauaucugaaagaaaauucaggguagggcaagggaggugauuucaauccaaaaaaaaauguacccauuuguauugagaucuuuauacaaauuaaaauuugaacaguaccauggcgcaugguuaaaagacacaaucuagaauccaaccgcucucuuuacguccaucuccaccagacauggcugggggcagguuacuuaaccacucugggcuucuugccuccuugugucugagcaugauuauagcugcgucauuucacagggccucucacucgccaaacaaaugucuuagaaauguaucugguaaagaguggcaugugaauacuagcuccuuucucugacuggucgccaacauacauuguauaaaaaagcaagacauuugaaaugaaaccauaaaauuauuaacugaguauaugucacuuuccaguuuaagguggucucguuauuauauacagaaauuggaaacguaaaagggaacuccugacaucguaaaaaaaaaaaaaaucacuagcuacaaaauuaacagucagguaguagcaaugggacaaauggcagggccaacuccaaaacacaagucaacaaaagcccuaacggguaagcaaagucaguacaacauguaaggcugugcuccugucucuaauaccuuuuuugacuacccagcugcuaguuuuacucucuauccccaggacucccauagagaagaaaaauugaagcugaauccuuguuuccugaccucuucugcuauaaggagugaacaucaucucugcuuggggccaagaagaucugagaagaauaaugcugugcacaacuagauuuccuccccaagcaacacggccaggcaggcaugugaaggcagagccacuacccuaggacacugcccuuggcuuccagccuuugagaacaguagcaagaguuugugguggguggaacuuuuggcgaccauguuuuaacugauuuuugucauuaagacaauaggcugagcaggaaggguggacagacaagaagcaggaggugacauuauuuaaucaccaaacauagaauggccuuuguccaggccuccuuuaaauuagauguauagccuuguguguuaaggcaauugcuacuaccugcuucaaacugcucuuacuggcccuacuaaccugucuguagugguugauguagguaacugacucuucuguugucucuccugacugccuucccuccucuaucucuggcuaucccucguugacccuucuuuaagauuucuccucagccucuauuuuaagcuuggaaguuccagacaggugcccuuggccacauuuccacgugcugugugugccuugguguccucaguaccuacaggcugcugaaucugaaauuuguaacccucgaccgagcuccuccagacuacacacuuacaggcacuacuccauaucugucuuauaucuacucaacuuaguaucucuauaacagcuccugaccuccaccccuucaaucuuucuagcucagugaaaaggcaccaccccucuguuccucaucccucauucaacccaucagcuuuccuucuaacauccauguaucggucuacagccagaacccgccacaguccuggugcuaaaagaauaccuuuugcuauaacugcaucaguaccacuuccucuccaguucccaaccucacuugcauucagucuacucucaacacagugauccuacaaaugcuuaagucacucaggcucaaagacaacguccuuaugaacuuuaagacuacauauaacccagcucugcaugccucugccuucucgguuucugguggcuacuugugcccuccauucccagagcacagaucccaagugccuccugcuguucacucuguuuccaucugcuauucagagcacuugcuccuucaggccagaacucacaaccccucccuacuacacuaaaauuucaugccucccccccccuuacacacacauucaccucauaucuccacuucucucuuuuagcaguuuuucaaucuucuuagauuaucaguacccaaaauacuuuacacuucauucauauauaacccauguuacacagcaugacaauauucagggccuguuuugaucuuguauucacuguucucuagcacauaagugaaucuacauguacucaauaaauauuuaaguaccaaguuauaggccaauuaaaauaccauuucacacccuuccuaaaggugacucucuggaaagaacuucagaaacaacaaaauacuggcaagagcuuuggaaaaaagucuucugucaucagaggugcugcaugggcuugcaugcuuuuucugaauggcaacucaauaaaguguacccaaagcguuaacaauguccacacccuuggguccacccagaggaauguauucagaaaugccugaccagaauagguaugccugcacgaaguucuucuguggagggcuguuuaauggagcagagugguggagaccuggaaaccucuggaaauggccaaaaccauggaagacagcuguuauggauugaacaugucucccagaauauguguugaaaaaaacaaaacaagccaaugcagccucaugaggagaugggcugggagaauucugagaauucucagaaaugcaguggcucucagucuucccaaugcugugacccuuuaauucagcuccucauguuguggugaccagccauaaaauuaucucaucacuacuucauaacuguaauuuugcuacugugaggaaugguaaugugaauaucuaauaugaaucguaaugcaggauaucugauauacaacucccaaaggggucacgccccacagguugaaauuugacuucauaguagaauaaggcuguccugcuagugcguggugacuggacagcaggcucuuucugcaggcgaguuugauccccucuggcauguuuauucucccauacucccuugcucugugucuuuugcaggggauaacaccaggaccauauucuuggacuccccauccuucagacuacaugccaaauuaauuucuauuguuuacagauuacacauccugugguauucucuuauaccaugcuacauauacuagaaccacacuaugaauaaacaguacaugcagaaaauguagucacugaaaaccguggcacuaauaaaauuuagaaauuguaaacauggggcuggagaaaugggucucaguuaagagcacuggcugcucucccagagggcuugcguucaauucccagcauccacauggugcgcaugguggcucacagccagcuauaaugggaugcagugugcaugcagauaaguauucacauauauaaaauauguaaguaaaucaaucuugaaacagcagguucaucagguaccuuguuaacaaaaagugccauccaguaacuaggugacugcugauccuucacaauggauuucuauaaguaggugguauauaauaugccuguaaacagcucuauacaaugcauaggaguacuagccauauauuuggacaccagagguuguuauuaugagugguagugagcugaaagaguccccugccccgacuuuccacucaaaaugccacccaccuuuaaaauaacuacuaaaaugggaagaguagaaaacugaaaagcuacccaaaucaaccaauuaaaaugcaaagcauuaaggaagucaaaccaucccggcuagcuuugcuugaacacuuccccuauguucuauauuacagaccuagcuucuguguuuccugacuuuucugguuggcagccagaacaccguuccauagaacacuagaacacucacugaccauccaccucccucuguguuuccagucucucugcccugaucuugucccuaaccuuuacaaucucuucugucuauguguggccucauuuuuguuucuggcuuuuguuuguuugcuaggcuugguuuuugagauggugucucuguagcuccaaucuggggcaaucuccuugucucuaccuaccaagagcuucaguuacaggcacaaaccaccacaccuacccuaccggggguuuuaagcaucagaaagcaccaacaucaauuaagguugaccuuuaagccaaguaagggugcaagccaaugucucaguucccaugcuguuauuuguacaagugcugcuaguuaccuucuuuucuguuagaagaacaaaugaaaugagaagaaccccucgccucccugacucggcuauuaggaaccauggugugcaccccaccacuuuucuagguuuggauuaugacauaugaccagucgcuguccaaccagauguuaacuaacuaacuuuccagaacacaggguuucugcuccacucuaugcuuauuuacugcuaaaugugacuucaggauuuagccacaauaauguucuccuaguaggcagggcauaagaaacuacccuuggcguaacgaccacagcuugcuuagauucaaagguaagcugacaucacgaagccacagcaacaccggugagucacaacacaaacacucccagucccaagagggguaauuugacagagaaacaagaacaucuacaaggcaacuuucucacgaugccuugaaucccacagaagcgugguguugaugguagugcugucgguaccugucucugagagcacuuucacaaggaucggcuguuucagaguggggauuaagcaaaaauaacuuccuuagucaugggccugggaaccugagagaacauucaaaauucagaauguaauuuaaaaaaaaaaaaaagacucggaggggcaugagugcauccuuccccagcuuuccagaaaaagauggacggggucuuucuacgguuaccagggaauuuguuuagcauccagcacuuacacugaggauccaaaaaggaauggaggaagagacuggggcagggcucaguaggacaaccauucaauuagcacacacaggucuuggggacaaccccagcaucaaaaccacaaccaccgaagacagcuuccaggcucauuagaaggcaaguucacaagagaacuccucugaacagguagcuuacuaagacuuggacauugaucaccguccugaguuuuuccuuuccuaggguuacaagaaaaaugaaugcgcaauuaaaaucucugcaaacucuuggggugaaucaucucugcccaaagugaaaugcaaaguagagcaaagcucucucccucacuucugaccucuaucuagucucacuaaucuaauauccacacacucccgcauccccucuaccucaaagauaaacccuuugcaagccgccccacugugacuuuuucaaugcccgaccacuggucucacucaagccucccggcucuuuuggaagaggcuugcuuaacaucaucuuaagucggaaacaugcaucuaccuuuggaaguacuuuggaggcaugugucuuggguuagggucuuacugcugugaacagacaccaugaccaaggcaagucuuauaaaggacaacauauauuuggggcuggcucacagguucagaccaccuaaucgugccaaucauuggccaagcauauaccaaccaucacagcauguauuuucugaaaaccuuuucuugcucucuuccuaauuuugacuuaugaccucucccuggauacauagaacuaucucaaauacaaauccguaggcauacccuugagaccauucucuacuaagcaggcaaaucaggacauccaugauauuuuaaauacauguucuauuuccuauuccccgaacacuggaagagucucaggauuugcaucuaggugacuagaacucaucuaacuccagcucccuugaaacagaaggucaacucucacugaucucaaaacacagucuagucuagaaccugccagauacaccacagccuuucagaggcccugcugaugccagcaaccuugucuacugacacacucccauggacacacuggaagaucagcugauaaugcccccauucuccuccagucuucccuuaggcugaguugguuuccucucuguacuguagcuacucagugcuuugucuaaguccuccaucaaagccagcuaaaggacauuuuaaaugccuguuauauaacagguacaucgugcugaguacuggggaauauaaaaauaacucaucccuggacucuguccuauggaugugaguuuggcaggagacggguauguaagaaaaucaccacccagcauaguacacagucuagguggccgggacaucagugagaaugcucggcuuggacaagccucucuccagucgcuauccccaauucuuaaaggaugcugacuuaaucauauuuguagccucagaaucuaguggacugccaaacacauaacagguacucuuauuggcuaauaggcugcagagugacacgucacaugucccucucuaaacaaucaucucccaauuagugcugagaaccaugggacaugucaagaaagacuaaauucacagugacaauguuggggaggaagguacaugcuuucccugugccuucaagcccuacuugcuccagcuucagccucugucccuucuccagcccccuuuauaaacgguuguuacugcacaguucccugggacccacacacaagcuuugcugaacugccugaugagucggccuaggaagucucucaccaacgugcuuuccugucauuuccagcuugugcucaguucucccagugagaucuuucuugacaaugauguauaaucuagcucugagcuauucucucuccuacacuuaucgcucacuggauugucuacugaacauuucauucacuuguuuucuaguuucccucauuugaguauaagaaucacuugggcagaaguugccugucucuuuccuguguauucauguaaggacggauaguggaguuuggcacggaucucacacgauagcccaggcuggccuagaguuaauaauucuucugcugguaagccucugagcaccaagauucuacgaauguucaacuccagcugucuguggggauauuuucuucuuuuggaguucuuuaucucuaauaccaagcacacaagucagcaugaauaagcagucacuaggccauugucagauuuauauucccuuuaaugcagucauguuaggugaugaacaaguguauggacaaggcccaacaacaaaacuuaggucaucaguguagcccuauugccagacuccacucauuauuagcuguguaauuucgguaguuacuugaguuugcaaaccuucagauacuucauguggagacgggauaaccacugcacuuaccccucaccagcugugagacuguacacacaagaaagcuugggauacggccugccacacuauaacugugcuccuccccagcccaucaguuccuguuaauacugcagcagaaguccccagacacacacgaacauguguuguagguaguuacagauccaggaauaucuguuacuaacucugaaagacuuacuaacauacugauaauuucuaguuuuuaauaacuaauggacauaaaagaggaaauguauauuuuuaccaccucccucaaauguaggaaacacuauacaauuuuuauagauuuuaaauuauuucaaaugcugaguaagggaaaaaaggggguguauacaaaccaagaagcuguacaacugaaugaaaagaaaaacucacaacaacagacaggucguuacuaguucuggauguacuaggaagggauuuauuaacccacaaaaagucaaauaaauauggugggucaacucacucccaaacgcucuuucucuagaguaaaaaccaaaacccaucccccgcaagcagcccuuacucagcgcuuuggguagcuuuugguuggugcaagaggguugaucagacuuucuagcgcagauaaauguuccaaggaagagaggguguccuauccugccuuggucacccugugguucacacgggucgccgaggggacaguuuuacacuacccagagaggcacaaccauagcagcccaaaucagugcaacugaaaggaguggcuagugacgcucuguagacaccaggacggaccauagcacaauggaccuccuggcugagcacuuccucuguuccauuaguuuucaauaauccuauagaaagaaguauuuacgucauagaaaacugagaagauggcuuaaagcccaggaccuaagaagccuacagucccucagacauuuagcugaggacaaaacaauuuuuuucuauguucagaacugaugguccgauggcgcuucuucugugugauagcaucaggccaagagcuuaaagcgucacggccugcuucaaauccaccucggcucuucccggcagcaaaaccucaguguauguaugucacugaacucacccauguugggcuccuaguucuuacgauggaaauaagccucagaaaaucacagugaguguuacauaaacucaagaggucagaugauuaaguuagagccgagaaacuggcauacauacauuaaauugagccagcugauaucaucagcgugguaauaauuggcuaggaaaauucccaucauuaucuaaucauauuuaauugaguucauuaacaaaacaaaaacaaaacagagccggggaucuaguccaguggaagagcacuugccuagcaugcucaaggcccagccaguguuccggaguucgauccuuaccaccgccaucaacaacaaaacccacacucugaaagagcaaaguacuugggugugacuuacuuuauauucugugaucauauauaaauuuccauauuugacaacacgugaaauggagguaccccaauuguaacuguagucugauagucagcuuaaagcuuuuuuaaagaacuguuauuuugacuccgggucucucugcuugguuuucuaaaaagauugauugaaagccccaccuugguuggacgacugcagccaguuaccuuuccgccagcaagacugggggggggggcaggggccuccauuugguuucgguugcagacgcacaaacacuucauuguacagcagagacucccgagguucucuccccucuucaacucagcggugucacauuuccuguccccccucuccaaauaccucccaauucauggagauucuccagagaagcugcuaauuuuuaaacauaacacugcacagcugaauugucuucugucuuaccucagcuagccaccacaaacaccacagacuggacagcccaaacaucaggaauuuaucuucucuuauuucuagacacugagguguccaagaucaagaucucagcuaaguugcuugccagccugagucucuucccaagacaccccguugcuccugcaucucacaaagcagagauacagcgcuggcauucuuacucuuccuguaaguugguuuagccuagggucuuaucuuuaucuuaauugugagaccuucucacaggcccuagcuccaaaguuagggcuuccacuuuuaaauucggggugacacaagccuccaguccacagaagucuucuaaccauacagaaguaaaacuuaaauucaaauagauaauaaugguggcagucacauuuucuccuagucauguguagaaaacuauguguaaauaggcaugaugacacaugccuguacccuaggcgcucagaaggcagaggcaggaggauugcugcaagaucaaggacagccaggcuacacagcaaguuccagaugagccagugaaacagaauaaaacucugucucaacaacaauaaaacaaguaaaagaugauuuaguuuuauaaaaucagacugaaaauuuaaauacguccaaggugaccuggauucaauuuccagcacccacauaaaaauaaaaacaauuuuuuuuaaacagauccacauuucucuuauagauauaacacaugguaaagggacuuuuaaaaaggacugaucgucuccauaaagaguuccaucugcuuaaauagaucuugggcagggacccaauuucuaaagccguguguguuuguguguguguguguguuugugugugugugugugugagagagagagagagagagagagugcaagcaucguauugcucagauaaucaugcgaggagcagccauuucucaaagaaacuaggugaauuccauuucaucccuaguaaaacaagccugcaaaaacuauuggauuccaagauucugaaacccuuacucuugauaaguguccaugccaacggaggggaaauauuugccagaaccuggcagcucgcuggugccagacugaaaucagaacacaggaccccuaacaucaaucaggccagggugccagugaccacagcuccacguggcaccaaggcccaggugcuccaaacaucaaagcaggaauggagcucuccagcccuggugacuuccaagagccacaccaggcagcagcaaggaagaccagaacucagaucuccuuccuggucugcgcccagugguggcaauauggaaaacaagaacuacugcuuucagacacaucuuagcuuccccauuuuccucccaaaugaugacauuuaauggggccccgaguuucuguccauuuaguuccccuggggaugggcauuagcuaccgaucucucuccacgucaucuggggucugcuucuccacccuuaugagccugauauuaaccaagaaucuaaacagcacaugccuggaccuagcagcuuugagauagauagaacccugcaaaacaaaccuaaaaaugcuaauugcagugcaguaaagagguccuccgggauucggcuggcucuauaggcucugugaagcaucucacaugcaaaaacaucgucguuaggggcacauuuuuuaaacauucaauacuagucacuauuuuuuuuacacgugaucuauccaauaugucuuuaauuugcucaaggcuguaccugcagaaauaagggguguucccugcggagagcucucucgguucacuggggugacuaaacaggcuuuucgucucagucuaugaaaggggcgaauuuugcacuugcuguuccagcucauuacacaaagcaaugugcacaucugccaaacugaguaaggcccuuaacagccguucuuggugcugcuaucaaauuucagccugauucggcuuuaaaacuagaacuucugaaaucccagccaagguaaacgaaaguucacauuaggaaaguuuuaacuuuucaguugcuguucuagcccccuaaacugucuuucauuacaauucaaaagaaaaaaaucucuuccuaugugaugggggcacauuaugaaccuuuaaaaaaccauuacaguauguuaagugcuuagcuuaguuuuauuaaauuuauuuauuuaauauauguguguaagagaacgagaccaugugugacagccagaagauaacuugugggaguccguucucucuuucuacacaacucgggucaucaggcuuggcaaccaacacccugagucaucuuacaugcaugcauauguauguauguauguauguacauacacauagacauauauuuauacauguacacacauauacauauacauguguacauauauagauauauacauacacacauacacauauccauuccagguggggcuuaaccaugcaacccuccugccucuacuuuccaaauagauuauacaggugcccaccacacucaguuaaaaaauaaaaccgcucuuguguucuugcuugcuuccuguagcuaugauaaacaccaugaccaaaagcaacuugaggagguaaagauguauuuccuuguaaacuuccacaucacagucuguaauggaggaaagucaagauaagaacccaaggcaggagccaggcaugguggcacacgccuuuaaucgcagcacuugggaggcagaggcagcgaauuucugaguugaaggccagccuggucuacugagugaguucuaggacagccaggguuacauagagaaacccugucucgaaaaagacaaaacaaaaaacaaaaaacccucuuggacuggagagaugacugagugguuaagagcacugacugcucuuccagagguccuaaguucaauucccagaaaccacaugguggcucacaaccaucuguaaugggaucuaaugcccucuucuggugugucugaagacagcaacaguguacucacauacauaaaauaaauaaaucuuuaaaaacaaaaaaacaaaacaaaaaacaaaaaaacucaaggcgggaagugaggcagagggaccgagggaggacuggcuuccagucugcucccaguuugcuguuuagcuaccuuucuuucccagacuaggccccuccugccucaguguggcucugcccacaguguacuggucccucccacaucaauuagcagccaagaaaaagcucuagacaugcccucaagcccacugaugaacgcaauugcuuaauugagguuccuucuucccaggugcaaacugacaaucaagaucaucacaagguuugcuacacuagccaacugcacaguuauaauacgcacgcuuugggagagccuggaaguugaggcacaucagccacucgccagagacgcuuugcacugcucaaaggaaagaggcugugcugucuccucagacggcccuucucuccuguuggaccacaauaagcucgcugcuuuagcgacauaaugcauuggcucuaaaaccagauggccuuucugcuuucugccaagccuaauuucugauugcaaaacauccaucccgugcuacauaaugagaauacuugaguuacuuuugccuuaccagagccggacacgcgccugauccucugaggcgauaaggcccugucggagccuaggguucuacucucacucuuccuccucaggcaggcagcagugggacccacuuuggcuuuuagaccugguguuuuccucaggcuccgcgagucuggcuuggaacugcuccuuccuggcgugguggaaguuuugggugcagagcccugugaggaaacaaaccaguuaagauuucagucucaucacacuuucccccccaauuccaucccugaggcgacagcucuaugagacaaacccucugucuugguggcuuuaccaacaauuaagacuccuugaggagcuggagagauggcucagugguuaagagcacugacugcucuuccaaacauccugaguucaaaucccagcaaccacaugguggcucacaaccauccguaaugagaucugaugcccucuucuggugugucugaagacagcuacaguguacuuagauauaauaauaaauaaauguuaaaaaaaaaaaaaaagaguaagacuccuugaagcugacuucaauggcccugauauaccuuuaggcccaguagcugucugguuauuucuucccuaggccucauucuuugauaccuuucaagguuagucugagccagggcuucaacuuggucuuguuaucuucccuccccaugagcucgcccuucauagcuugucuuguauuucaaccaugaaugaugcacucaaaagucauauuuccaagccaacacucucccccuucaguugccccugaauauccccacugagaucuuucuacucaauaacaauuacccuauuauuauuggcacucacuaacacagagcccuuacacuacauaaaaagccauucuaaauuuugauuuuuagcuagcuuacaaaauaaugauauuguaggucauacaaaauguggcaguuuugcacauauacaguuuuuuguuguuguuguuguuguuguuuuguuuuugagacaggguuucucugcguagcccuggcugucaugaaacucacucuguagaccaggcuggccucaaacccagaaauccaccugccucugccucccaagugcuagguuuaaaggcgugcaccaccaugcccaucacauauacaguuuuuauuuucuuucuauucaaucauucacuagcccuuauccaucuucccaacucuuuccuccuacaucaaaauaugccuucuacuuuaaaaaaaagauuuauuuauuuuauguauauaagagucagugcucuuacccgcugagccaucuggucagccccgugccuucuacuuuuaugucacauuuaugugugcauauguauacauacgccuccauauagauacuugaccuagcacauaugagacaaaacaugggauuuuuuucuuuucuggucuucuuuaucaucccuuuugcuccugauuuuuccuuuucuuagaucucucuucuaugucacagucacucuauuuucaagauguacacuccugaauacacacauauuuauauguguacacacacacacacacauacacgcauacacacacacauauauacacacacacacauacacacacacaaacaaauuaaaggcagaaagagacugauucugcauaugaaagaaacauaugugguuugagucugacuuacuuagugcgauuucaaguuccauuaauucuccuauaaaugacacaauuucauuaauuuuuacagaagaguuaaguugcuuugugcaccuguaccacugcuccaaucagcucaucugcugauccacaucugggcugguucccuagaugggcacugugaauauugaagcaguaaacaugcugugguucucucuguggucaggcugacuugcauuccuucaaccaucaccccagaaguacagauaggucuaugguggcucuccauucuaaaaucuaaacaugugcaucaacuaauuuaaaaucuaaacaugugcaucaacuaauuuaaaucuguuuugggggggggguuuguuuugguuugguuuuuugagacaggguuucuuuguauagcccuggcuguccuggaacucacuuuguagaccaggcuggccucagaaauacgccugccucugccucccaagugcugggauuaaaggcgugcgccaccaggcccggcuuuaaaucuguuuuuaaccuaguaagauuauuggucauaccccauuuuaaggaauagcauuaaaacacuuuaaaaaaaaaucaaguucacaauuuacaccugucuccuauuaacauauccagcuacccaacuuaaacaaggaaagcuguuguguguucugauggguuuguauauucuuggacuaggguguggcaccauuuggagguguggccuuguuggaauaggugugacuugguuggaguaggugugucacugugggugugggcuuaagauccucacccuaguuaccuggaaaucagucuuccacuagcagccuuuggaugaagacuuagaacucucagcuccuccugcaccaugccugccugaacgcugccaugcucccaccuuaaugaucuuggacugaaccucugaaccuguaagccagccccaauuaaauguuuuuuauaagacuugccuuggucauggugucuguucacagcaguaaaacccuaacuaagacaugugucuuugcugcuuuucuuggcucuugaacccauuuuucuaccugccuucauauaaaaaagccagccucauuucucaaaaugauugcugaaaucauguccuugaggcuugucuggucuccccagccucugcuucuucuacuccccuacuacaaaaaucuuccaaaaacucaacucuuuuaaagucacagcaaauccacugucauugucuccuugcauuccccucucccaucacaaccucuaccugaaccuggcaugcuugcaucagaauacaucccugugcucuucaucuuaacacuugguguuuucucagcccagcacacaagcccuguaagcuacagccagagacuaaauggccucgucaucagaagcuuucuucucuugauagcccucccaacugcuaccagccuuuccuccaguacacagcacgccauccacacuccugacucaguacuuagcaugcccuuauggcuuauuuucugacaguaacacugcauuagauaaaacauuggaccauagcugucuuucuugauacccuaacaaguacuaccaucuguggcauacacaguagaugcccaacaauuguuuccacuguagacauaagggaacaggagccuggcucugacuccaaguacaaccagcuucuaacacuauaaaguacaauuaccuucucucuuuacaaagagaacaacugagccucagagagaggccacuuugcagugagugguaaagccacacauuuaaaguuauccaaaauccauguucacgcuugcauaugcccuucugugugcuccuuuguuuaguuauuguuuuauauauuauuguguauaucccuaacaccaguaucuauugaauucauauacuauuccaauagcuaguguuuccaagagaacugcugcaggucacaaugacacuaaagcaaaacagaaucuucuagaaaaacuuucuugaaaaaaguaaaucaaacaucaacuuauagaagugaaucucccacaaaucacuuguuuuaccuccagugcccacauacugaaaaauuugaagucugugagaccugugggaccugaguuugaacauccaacagcugugugcguuuuauuuuauuuucuuuuauuuuuuuaagauuuauuuuauuuauaagugcucaaucugcauguacauuugcaugccagaagagggcaucagaucucaucauagaugguugugagucaccaugugguugcuggggauugaacucaggaccucugaaagggcagucagugcuccuaacuccugagccaucucuccagcccccugugugaguuuuuaaauaaauacucugaagcaugaguguguggauaacaauugcaaacaaauaaauacaauguauaagcccugagcguuacuguaacaauuuaaugacagccuauaagaaagcaccuaagccaugguuccuuucaguaccagcuccuucaucuugcuauccugaccacauaaccuuugcaguaagcaguuacuucucacccuaacagcaauccaagucaaaaucacuucucccaaauaaaauccuuucuuaaaguuucagguaaacugggaccaccacauagccauaagguggucggcagucuugauaaauuaauuuaauuaaggacuaagaccuacggaguacacaagaaaacaaacaaaacagccauucuucuauggcagauagagcucuuagguacuacugaagugaucaauagaaaaugcaaugugaggucaccgguuuaguauccuacacuaagucauagccuguggcuaugaugguuacgcuagccucuuuacccccccucaagauagaaaaaaaagggugguaguugaauuagacaaauuggacaaauuagacaaauacucugcuguauuaaagacauggucacagaagcauagcucuauacucuagcugauaaguaaaaucgccagugaugacaccgugggacccuugggaugguccuuacagccuuacaaagcacuucauaucuaauucucagcucuuacugcaacacugcuaggugcaaacuguuggaauccaccuuacccaacgauuccauggccuuaccuucaauaguacauacacaucaugggcccacagcuaccaaguuggaaauauaaggaaacaaaauaaaacugaaacucuccagucucagaacuacacaagcaacuuauuuucaagaccagugcucaagggacuucaugcugguuuucccgauacugaagggugacagccaggacacgucucucauaaaacuagacauggcaguacaaaacuauucuuagcacuaagggugcgaagcaagaggaccucagauucaaggccggccuaggcuacugugugcugaauucaaagccaggcuggcugaauguggauacccugucucacagcaagaacaacuucccauaaaguaaugaaaagaauaucuugauucuguguaggucuauaaacaccuaaggcuauugauuacaaugaagaguuuauuguaauuguauuugguaaaauauuuagauucuaaauuaucagcuuccucagacauaaaaaagaacuugaaagaucugugucaugaaacaauacacaagcccauuuuagaaaacccuguaacauuucauccuugccaacaguuauugauaaagccaaaacaucuaucuguaaaaugacccaggucaaacguaucuccaguguuuucuuaucauugagcacacaccuaugugaccuacuauguuaccuggaaaaaaaaaaggucucguguacuugacuaugcucuguuuuauuccuccuacacaagcguccccgaaagacaggcugugugcacugcaucugucuuccgccucugcagcagauccauuccggguccagaggacaagcauuucaagggcaaucuguguggggcugaaaauacaccuuagucuccacugccaaaaauagagcugagaacacacaggcagugccaacagcagccccgagaauguuuugaaaacaucuuaucauacaauugucaaaagacaugcacauguuuaaagaaaaauaacccuugaacugcgaauauugcuucuuuuuuuuuuuaagugacucuaccuagucccucauccucaggauucgucagguacugcugcagacauacugcuuuguuuacuauguaaggacuuuuguuucuuucaugcauuagaagucacugcaggugaccuacaggugaccuuacagacccacugcacaauccuuucccuucuggcuguggcaaaguuaccugaccccaugucacagagcuggucagaaguacacucaagcuuugaaaagcgucuuggcuuccuggauuuccauguugcuaugcuauguuuacaggcacuaccuagccauuucuaaaaugugucucaauauguuugaaugcuuaaagcucuuuuuuuuuuuuaauuucaggaaaacaacacacaaccuaaucgugucaguuauuucaaugcaaauaucaaaauaucauaaaaauauuaauuuacucuuuuaaaacccuaucagaaggaacacccacguucaagaaaauaccaaaucugaggguuuuuuuuaauaugcaaguuaguuauauuuugacucauucacacucuauacugccuggcagaacaaagaacagcugacuacaaauuacgaaccaaguucagggauauuauuagcaauuacaggccacucauugcuaauacagugguuuucuucaccgguccuaaaagcaaacugcagaguucacuuaccaccaauagagacuuggauucaaaaaucucauucguggcuuguuuucccagcucuugcuuuuccaugggagccucaccguccugcucacccuuuucagggcuaaucugaucgaugugggaaacguaagucacuuccaaacacucugagcuuuucauuuucacggggagaaugccuuugaucuucuggaagaaggcagcuacagacccggucucacucccugcaugaggagaaccugucuugucaacauucuccugauucgauuucguggcagauguuguucuuggaaccccgagugaagcauuuuuagaaugaguuguaacuugcgcagccuggcugguaaugaguuuauuaaacuguugcuugugugucuuguuaauugggauuucugcuuuuuugcuggcuuuaaagucagaucuuggugcuuuguucaucauugucaaguguuuagaaggcccuggugauggugaagagcccccuguuaccugagggcuggguguguccuucauuauggaagugucuuuggguugcaacacugaucuggauauaacuuuggcuuuaauguuuuugaaguuugguguaggauaacuuauaauuucugucuuccugacuuuacugccuacagugguauuuguuuugguagcugauuuucccaaauuagguuuuggcauauuuguugguuccccuuucaaguuuggugcacguuuagcaucucuugguccauucuccacauuauuguacuucuucacuucagcagguucaagucugaagcucagauugggggguugcucaacugguguugacaugcaaccugcuuuaucugugcaaauggcuccgccguucucgccccaacccauuucauaaggugaaccccucugcccugaaacacuucucagggucagcucuucaguacuacuuuggaugucugagucauugucgugggaaucgaugugugggucuucagucacagugacuuuacacucagagcccaggacucugguuuuacucuucucaaaagcuggcaccaguacugggcauucaccaucgacaugacaguugggcaguguuccucuuaaauuuuggcccauuuccuguugagcauacgggccgugugaaugugucucacuguuugggucaucuucagauacacaauagaacuccugugaugcagauccguuggggaccuccaugccauccgaaaccagugucacagcuuguaucucuuuuucuccaaugaguccucgccuugucccaucuguguacucuuuggugacauuuccuaaagaauucugacccugaacuccaacgucuggacugucaguuugcaucagcacaucagagaucacuguaaagguuguguuuagggucuuggaugguguggcuuggagguuuucaaaguucucucgauuauaauuaaccccucucacauacaucuuagaggaauggggugguguccgaccgcaggaggacaaagcauuucugucucucacuguugucugcaaaccuccaggagcaugcaaaggcugacccuguucaauaucauggcgugcuauaaagguguaguuagccguguccacuuucaugccauauguuuguuuuagcuccaaaacuucaggggaaucuccacaagcauaaucgucaucagaccugcacucacagggcuuaaggggaucaaacuucucauccuggauugccucuagggagucacaguuacugugcaggucuuggggcuucccuguguucacaagugcaggagacuggcagguaagcucacuguacauuguaaacucaugcuuccccaugaaaucacuugaaggcucuggguaagcaaguucuucaacacacugauggcuuaaagauacacuuucacuacuguccaccgcaggauccauuucauaaucgaccaccauggcaucuggguugucagaguuccaauccccgugacucacugaagggcacugggcagauagcgauguuugguaguauucagauggauucgaguuuuuaucucggauaaauacauaacgcgauccaucuucuguccuaucugaauuaucaucauucauccugaauauuaaccucaaaacucugccauuuuaucuucucuucaaauuccuuuuuaaugagaguaaaugaaaaaugguccagcuccuccccuuucuauugcuuucagccggcuuccacaacuguagucugagaugcuccaaagcugaaaugacuugucguucccuggaagaagcaaaacaguaaacucaaauaaauguuagaaaaauuuacagcucacuccuuaauuaguuuaacaacaacgucuaauuaccacucucuuucaaagaagccuuuugaugugugaaggaauggagcgugaugguuugguuuggaaaugcagauaaaguuuccuacugaugucacgggcugacaucuucgacucccagagacuucuuagagaagggaacuagcucagugugcaaccaucuuuccuucuuacugcucaacgguaaaaacauucauccuaauuucccuuggcaaucccaauuuauguccacugucccagcaaaauuccuacgugucccucucacugucagaagggcuccuacucugcaagguugccggggagaccauccaggccccacaaaugaguuaaacagacuuggagaauuugcauuucucuagucauucuaaaucauuccuaucuuaaccaugugcccuucccaaguguguguguaugggggggggggggagaacgauacuaagauuugaaguaagccaagcggagaugucacacaucuuuaaucccagcacuccggagucaaguggaucucugugaguucgaggucaaccugauuuacagagcaaguuccucaacagcuaggcauauacagagaaaccuugccuugaaaaacaaacaagcaaagagaguuaaauagccucuguuagagguuccucaaaauauaaacaaagucacuaugugcuguguaacaguuccaaauaaaugcauacauugaagccaaccccaucccucagguuugacuauauacuggagacugagucuggagauaggucauuaaagacaugagaaggguuaaauaacagcauaagggaagagggcuuacccaccagaguugcuacccuucugagaagagauaccugaagguccuccccucccgcuuagaguacagaaaaaacaaacccacaaucuuaacagaaacacuauucacaaaagcugaaaaauaaggguaggggaaacccaaguccaucgacugguaaguagauauuuaaaaaacaacaaaaacaaacaaacaaaaaaccaaaaacaacaacaaaaaaacuuguccauuuuuauaucacaauacucuuuagcacacacacucaaaaugaaaacaaaaaaguuucauuagcuacauggauacaguguugcaacaggaaaauauuacacuaagagaaagaaguuauucaaaagacuaucuauuaacauaacuauuuauggcagggcagugguggcgcacgccuuuaaucccagcucuugggaggcagaggcaggcagauuucugaguucaaggccaaccuggucaacagaaugaguuccaggacugccagggcuauauagagaaacccuuccucgaaaaacaaaacaaacaaaaagauuacuauuuauacaaaaauguccagaaccaggaaaccacagacaaaguacacuggggguuugugugggaaaggacagaggggccaauguuuuagggggcaaaggacagaggagacaauuugggggggggguaacaaaauguucuaaacuaauuuugcuccuaguuucacacuaccauaaacaaacucaaaauaacucaauucuauaauuaguagcaaacuuuuaagauguccagaaagagcucaaaucuaggcugugaagauggcuaagaagguaaaguuguuugcugguggacuggagcucagggcccagagcccacguuaagguggaaggagaggacggacuucucaagcucuccuuaggcaugcaugcacgggacaggggggcacacccucuuccccucuuuccccaucuucauacccucuuccccucgcucuuuuaaaauuuaaagauuuaaaauccaggcuuuuuuuuuuuuauucauuugauuaaaagucuaauauggagaauuugagaggguguguccucaccccauuuccagcucacucuuucugcuuccuguguguggcaaagugcucccucucaguuuccaacuccagcugcccacccacggccaggcccuuucagcccuuguggacucucugucuagaacuguaagaagcaauaaaccuucuaaugucauggugcugaauugugagugaaauaucugauagggacaagggcacugagugaucuauaaaauucugaauuaagagcagaucugauuucccuacuuuguaaucuuuauugcuccaaauucaaacuccagagacccgaguauaaaagucagaauaggcagggcggugguggcgcaugccuuuaaucccagcacuugggaggcaggggcagguggauuucugaguucaaggccagccugaucuucaaagugaguuccaggacagccagggcuauacagagaaacccugucucggaaaaccaaaaaaaaaaaaaaaaagucagaauaggaaccaugaagcaguauccaauggcccugguauugucaccaacaguuuugagugcucugaucaugcauccugaaguuagcaucuacucgugcagaggcaaggaggaguauuuaucucaacagcaagugugcacauagauaugcauugacaacaugugugcacauacagaugcauccacacagacacacauaaccuaaacucacauacucagagcucugaaucccacaacggaaacugaauaauuuauauauuuacuguaaauuagccaaguccuucacuaacucuuaguuaaaagagaucacuaaagggauuuuuauuaagaucuuuaaaguuuuuauuaaguacaaauuaucauuuuauuacauggguuuacugugugugcgugcaggcuggaguguacuguaugccucagcacuuccuacaguucagagggcaacuugugacaguugcuucucuccuuccaccacaugcgaaccagcuuucaaacuucaagcugucaucaagcucgguggcgagucaucuugcuaaucaaucccacagauuagcauucucaacccguuauaaaauacauuuaagcuaacuuuugaaaucaaaaacguuuauccauuuucagaagcaggaaaugauguaccuuugggcuuccugaaggguagugauuguugaagaaaaugugacacgagggagucacauuuuaguuacuuuuauuuuuuuaaagauuuauuuauuuauuauuauuguacguauaugaguacacuguagauguacagauagaugguugugagccuucaugugguugaugggaauugaauuuuuaggaccucugcucucucugguccacucugcucgcucagucccugcucgcucuaccccaaagauuuauauauuguauguaaguacauuguagcugucuucagauguaucagaagcaggugucagaucucauuacggguaguugugagccaccaugugguugcugggauuugaacucaggacuuuuggaagagcagucagugcucuuaucuucugagccaucucgccagcuccuuuaguuacuuuucuguugcugugauaaaauaccaugaccaaaaacaaccuaaggaagguuuauugugacuuaaaauucuacaggaaggggccauaaugacugggagggccuggcagcgggcagcuggaguuggaaacugagggaaaaaacuuugcuacacauaggaagcagagagagugaacuggaaguggggugaggacacacacucucaaugucaacacccucccccucaucucacucccuguggcaccuccaacagagaucuacaucuccuuaaagcucaucaacuuucuccaaacagugccaccacgggaggacaaaguguucaaauguuuaaaccuaugggcacaguucauucaaaccaucggaggugaaagagaaagagcagggggugagggggugacagagguggcaaagauaaacaaguaggauacagacaguaugauacaguaugaaaaugccacaagaaaacccauuguuucuuaugcuaaugagaaaagaaagaacaaagaaagaaaaggaaaugccugccuaggcaggaggggacuauaagaacaauuccuggagggaucgagagaaucuguaauauguagauguaaacaaaacugcucauuagcaugauuauagaaguuaugugccuacaugaacagggucacuaaauucaacuaauagaauuuuuaucaccccaucacucuuuuccaaaguacauaaaagaugauugcauaaaaauauuuuuagaagauauguacuuaauaaauggccaaauuagguuauucugaaaagaugcaucacuggagaagccacggcgccauucucacguuguauguuauuuaaauggcugccaguuuuucucuucuagcauggcacuaaaugagaugucauugccaucuuugacuucucaucagcuccucugaaaauuaaaguaauauuaaagucaaagaacucggcuauaacaaaaccagacguuguguuucggcccccagggcugcuggcacuuuuuuauuuauuuauuuuuguuuuuucaagacaggguuucucuguguacccuuggcuauccugagcuugcucuguagaccagcugcccuugaacucaagagaucuacgugccucugccucuucaguucuggguuuaaaggcguguaugcugccaccaccacccagugucaguauucucugcaauacacauauuaacaaguauaaaucacagacauaggaacugaccugugcauuuuguuuaaugucaucugacacuauucauuauaggacacaaugugaaugaaguaccuugacugugaagauaaagccaugaacaggaaaagguuaaccauccuucccucgggagguaguuaaaaguggaaggcagcucaguccauaaaguguguggugucaugcaaauacacagacacuaauuuuuuuaaaaaggagcaguggggagagccuggggggaggggagagaaggggagggcaagguguggcucuggaaagggagggagggagggacccauuaaauaucuagucaguuuggccuaauagaagaggaguuccaggccaguaagagcccuagcucguuuugaguuuaaaaaccaacaacaacaaacaaacaaaaauaaaagugacugaggaaaaacaugcaaguauaucaggcacgugcacacacacacacacauaugcaggcucacuaacacaggcacacaggcacacauacauauacacaugcacacaagcauacugucucuggaccaauuucauuccuccuuacuuuuaagaauucuacccaaaggucaccgacuacgugcuagucacauagucuaugacuucaucucaccugacucaaauagucuucauauuccuaccauuacaauaggaucugccucaaguuuaaagaagccucaaaguuacugucuugaaaacauuuuuuuuaacguuaaaaugaauuuuaacagaauuaaaacagagcagaaaagacaagaccaaaccuugggagcaaaccauucuuacacccaggggaccggucucagguucauucagucgcgcugucuagcagagcaaagcacaaugaucaaguucccuuuggaaagagaauuaucugaaaggagagaucucugagcacaacuugggaaggacacaacaaauuccucacucauuauggauuuggcaauacaauaggcaguucauccaguauuuuucaaaaauaaauacauauucuuaagauuuuuaaggucaagaguugacuaaccacuaggcaggaggacugugcauucaaguaugacuacgcacugugaucuugucuugcaaauaacaacaaaacaaucaagaacuggaaaacagcgauaauuauauucgaaaccucagcuuuaaaaggguuaacucgguuggcucaguggguaaagaguucggauuccccagaacccaugucaaccagacccagaagcacaugccuauacucccagacccucuauaguacaacggacgucagcguaggucagcuagcccgguauacacacuggagaagaggagacccugucccaaaguagaagacaagcaccaacacucaggcuguccucugaccuccagcgugcacacaguaguacagguguggcuacacucagacacaagaccgugcauacacacuaagaguaaaaaugccccaaaacuugaaccaccaucacguaauugaacuaaugacugcugacauucuuaauccuggaaggaauuuuagagauccaacucaaacugcuuaaucuuaaugccaacgcugcuaaucagcugugagugaaucucuuaucagguuagacaacucuugguugugugcgguauuucacuaacuagccuacaaguccaggggaugcuuugcugucagcccacgcuuuauuccucuugcccaccaagucuauuccuaccacuccaauuuaauucauccugugguaauuuuaaaaugaaauguguuugcguaggucaaacaaaggcuagcuucacuauuuuauggccauacaggacuuaauuuuauaccuauucauguaugagaugucuuuuuuuuuaauuuuuaagauuuauuuuauguauaugaguacacuguugcugucuucagacacaccagaagaggacaucagaucccauuacagaagguugugagccaccaugugguugcuggggauugaacucaggaccuuuggaugggcagucagugcucuuaacuccugaaccaucucuccaacccgagcugccauauuuuaauguauauaaauacaaaaagacaguucggaauuauaguuuauaaaaaaaucauaaaaucaguuuccuuaaaagcuuuuuuucauaccuaggagcaggcaugcuccucucuaccuuucccgucuaucuuuuccugucuacuuuugaacaacacacgacucacagcaguaguugaacuccacaaaauaggcgcucacugguaaaacagugacccaggucugccaaggccacuucuucuaacagcucacuguggaaccauagccaguaucagucaaaucaggaggucacaaacuucccuucuacgcaggaauggaagaacuagaaacaguuguccaaagacuuaagggaguaagggaagcauucucguacgaauuaugucauguacauagcacaugauaccaaauuaagauggauaccaauaccugucuugaaggacagccuuucagccagugucauuuagggauucagagcuuccugagaauaaaaggagaaccgaaugggaagggagggcaggcuccugcuugucacucgaaaacaaaguggauuucaugacuaauggggcugucuggcuggauacuuagcccauuuccucuuccuuacuguauuccauuucuugugaaugcugugcauucuagacaagagcuaaguggacauuacauacacgcccacccccaggcuugcgccauaacacucagaauccuucacauucuccuucccucccacagggcuugacacagaugaacaaagugagacccuugugugucagcaugguaagaugccgggaccaugaaugggggaggcccagauccccacuucagugacuggaggaucaauggccaaucacaaaacaucagccucaguaaaugagcaaucaaguaaugauguauuggaaaaugacuuuuuccucuguguguguguauguauguuuguguguguauauaugaguggguauuauguauaugaguauguguauguuugugaauaugugugugugaauguauguguuuauguguuuguauaugaguguguguauguuuguaugaauguauguguguaugaguauauguaugugagugaguguacguauguguaugaacgaauauguguuuguguguuauugugugaauguauguuugugcguauaaguauguaugcaugugaaugugaguguauguauguuuuugugugaguguguauguguguauguguguguguauaugugugugugugugcauauauauauauguguguguguguguauauauauauauauauauguguguguguguguguguguguguauguguaagcgcgcuuugcuguuauaucauuggcacagauaccauagauuauauucugauaauacuguugcuuuggucacucuagucauucuuuuuuauuuuuauuuuuuacuagaugaagacuuuauaaauuaauacuugccuaauaggaaaaaaaaacuauuggaucaguaauuccuuggugguugacuaaaugacagaggagaagucuaacuuccuuguuugugaacaaagaagguguucagacagucaagcaaagaagcaaagaguuucuaagauagccuaaaaaaaaaaaaaaggaauuucuauguauuuucaucauagaggccagcaguuuauugaaaugagucccuacaugcagaacaaccucccuacuccuuuccugguauuaaaucuuccccagguuuguuugagaagucuccccauguuaacuaguucaaagguuggcaaacaaguucuauaaagacaaagugggaguacuuuuagguuuuguaaaauacacaaucuggaauuuguucacucaacccagcucuuguagaauaaaaaauagcuguagauaauaagauaauauccaagggaaugugucugagugucccuacuaaaacaacuuaccaaaaagauagggggcauauuggcaccaagaagacagugugcauaacccuggacuggcguaaugggucacacaucggcacuagucaccagcuacacuuaacaaucaucaaaauguacgauucuucugguuuuguuucuauuuuuugacucagagaaguuacuauuacagugcaccucagcauggcucaguucucucauaaguaauauuuaccuccauaaaauaucaccucaacaaucugauacaguagauuuuuuuuaaaaaaucaaaaucuguaccaaauuuguuuuccaauuuuauaaagccuaucaauuauguaaacuguaaaccucaaauuauacacugagaucuuuguaaacaaacaaacaaacaaacaaacaaaaaacuaccccaucagugaucgagcaugccucuaaucccaacacucaggaaguacaggcaggcagaucugagcuggaggccauccuguucuacagagcgaguuccaggacuacuugaaagacccacgcuuaagugugagaauuaagacccuguuuacugaagauguguugaccuguucaaguugggcacaggucccaaagaccauagaacugaagaagaagaaaaaaaaaaaaaaaagaagaagaaagaaaaacucccagaaaaaaaacucuaaauagccaugaaguuuaaggacaagaacccaaguuauaguugauggugguuaagucucuguaaaauaccauacgggagaacacacccaggaccaaaggagacugcccuucaccaauaaaacaaggguaucugccccauccaucucaauggcuucauguaaguccaauccucccuauuaaugucuuuaugaugccccaacuucaccguguccugggucuccaaggucccacagcucacaauuuuauacuggauacaguagauccuuagucauuacucauuccacccuuucuccaugagcauagacagaugcucacgccauuccauuuaauuuaggaaaagacccauucccagcuuaaauccugauauaaaucaugaaaucugaauugcaccugguggacucaaaggucugucauuauaaugcuuuaaaacucaagaaaaagaaugaacagugugagccaauauguggcucaaagagcuauucugaguacauucugugaaguucuccauuauucacaaaccagucuucaacaucaacacugauggucuagauggauguggugguccauaccuauacucccagcacucaggagguugaagcaaguggacugccaugaauuuggggacggcuugggcgaguuugaggcuagucaaagcuaaauagugauaccuugguuuuagggagggagggaggaagaaaggauaauuacacauugaggaaagaccugguagagcugcccagacuggaguaaggcuaagcaugguuuugugcuccuuuuuuuaacuggugagcuaaauaaacuccagcaacaaagacaaaggaucaaguaucaaaggcucgccucuaagucuggaagacagagaagcagucuucccaguucagaagcaagcacuucucaggcaaaaaggccugagaucuaagcuacagaggugugguagauugauuaggcuauggccccauagacuacugugcuugaaugcuuggccauggggcacauuaugaggaggugaggcauuguuagaggaagugagugucacuguggggacagacucaugcaaaaauaaauccagacauggugguacacaccuaaaaccccagagcuaggggacaaaaacaggccacggggacucacugggcagccagucuagcuggaaacacugagugccagguccagugagaaacccuaucuuaaaaaaauagaagcaguuuaggaagacauccaacaacaaauuuugaccuguaauugagcaucagggaagcuggugcaggaauauugcaaggugaaggcuaggcuggacuaugucguaaggcagucucaaaaagaaaagcucaagaaaugaaaacaugauguauugaugaucgucaaugguguugauggacagaaaaaguguauuguuuucaauguagggaaagcuaaauacaugacaggagaaggacagaagguaaccacuucaaagcgcugaacaucgagccacucuccuguagaagucucucuuaaagacaaagugguccuuucuuuccuuaucugugguuucguuuucguggcuucaauuacccauggucagccuugauccaaaaaaagccuacauggaaaaucccagaaauguacaauucauaaaugcuagguaacuuuagccacaguguaugguucuaaauguucuguucuuacugcuaagcucuugcuacgccugccugauaaaguaaccuguaucauaaguuuauacauguaggaaauaaacaacauccagacagcugagaaccacuugcgggcuucaguuaugucccagaagucuuggaaugaaaccccaauagacaaacaggcaaccaugcuuaucuaccuaaauuucauacucaugacagaaaagaauuuuaaaauguuagacagcaacacagaaccuucgcucacuccauuuagaauuaucuuuuuucccuuuuucuguuuuguuuguuuuuuaggacaggguuacucuguguagcccuggcuguccugaaacucacuccauuuuaggggugugugugugugugugugugugugugugugugugugugugcgugcgugcgcgcgcgcacaaguacacguguaugcauacaaacauucaugaagagaccaaacacaggacaucaugcaugcuugccaggcauguuacuguugaacuacuguaccccuagccaagaaaguacuuuaaaauaaaaucaaacaaauaccugaccaugccagagagaucuaugauguccagagucauaaaacaugcuacugaacuuaagauguaaauucuaguuagauucaaaugcagaagaaaacucuugguaaauggguagacacacaaauugucucagucaugcagaaguuugcauagguuauccuggaaugcuuguguuugcauagguuucccaauuagccacagagcccaggcccuaccucuccccuucugccaccuuggaucuguggcccagagcagcauuaccuguguuuugccgggcaggguagcaagagguauggaauccguuucuaacaccugacacgcuaacagcaguggcuauacuugccaagaagguagacuggggacuagcuagccauccuggcuggcuaaauaccuagcaggagauucuauauaaccaaagaugaggagaaaauggaaacugauagccaucucuccucgcugccucaggccuagugcucuacccagagagcacugcucaucacuacuaaugcaagcacucauacucagaucuuaagguuuaugucuagcguucccagacggguuggucuccaacaagugacacaguuuuggaagguuguggacucuugagucuauuuccuaaggugauuaaugguagcuuugcuuuucaaucuuggagcaaaauaugaauucagucaaagauguaaaaugacaauaugaauacuaugguaucauaguaaauacaauuagggacacuaaagcaugcauuugauaguugcuaugugcugcauuccagagaagguacauacacacuggauuggcaauaaaugaaacacaguaacaauuagccaaguugcuuuccagggaaaauacccacaggccacaggaguaaugaacaggacaucugacggggugcugaucuucacaagaagucagaggaaaauauagggggcuuuguccaacagagcuggguagugcaggcagaggagucacauaggauaggcuccaaagugcaggggaggcuggaaugucuugaggaagaaacucuaggagacaggggcaguaaagugggguagguagugggaucagcucagauucuauuuauuggcccuggagucugccggagcagacugguacuggccuuggcggagaugucaaucauacucuacuggagacaagcaguaggcaggaaacuguuacgagugagcugaacugacagaguaguggggaggaaauccagacaaaaguccagacaugcucccaaggcccggcacuguguaaccugcaccacgcaggagacagcacggcacacagcaagugcucaauaaaugucuguucaauuaaacauaauuuccaaggauucuuucacuuauauuaauauuuaaagaaggaagcuacagaagauaguguaggcuugaagcugcugcauaaauaaucuaucauguucuuuguugguacaaaaaggauuucaagcuuucguuugaacuagagaaaacaugauggccccuuuucuuuauaaaaaacuaauauaaaaguuuagggcuggacuguguaacaauaaaggguggaaagguucacuacccauuucagaugaagcuuaaagagcgccagagagaucuggguuaaaaaugaauaauuuauuaaaacacagagaaugauacuauuuaaucauccaaaggaaaacaaucugcugcuuuuuaaaacacacauuuaagaauuuuuaaguagaaaaugcaacaaugucagaggaacucuuuuauaucccccccccuuuuuuuuuuuaagaaaaacauuaaaacuaucucaacaaaaauauauucaucucccacucucucucacucagaagcuauauacuaagguuuauuuguauuuaagauacauuugaugcugggcuuggcgcgcacacacacacacacacacacacacacacacacacacacacacacaacuaagacauuucccuuggauucugugccaacgaaacauuguaauuucucugaacuuuccuggacagaacacauagauguuucuaggugacacuguaacuuaucaacugcaguagaagucauaaaagcaaaaguaaugaugacaguacuuucauucucuguacagaaggcaucuuuagcucuuugccagauuaacuagcucagcauuagcuggugcuagaugauugcuucuggcauaaagaaauaggauuguuccaaggacucagguuauagaguugaaaaaaaaagacguucaauauaucuccaugaucaauguggggacauagauuuaaugcuauaauauugcuguaaucccagaauuugucaaguuagaagcaggagaauuccacuccggaccaguuggaacugcuugagauauuguuucaaaaaacagaaacaaggggcuggagagauggcucagcgguaagagcauugacugcucuuccagagguccugaguucaaaucccagcaaccacaugguggcucacaaccaucuguaaugggaucuggggccuucuucugguguuucugaacaguguacucgucauauauauaaaaaauaaauaaauaaaaucuuuucuaaaaaaaagcaacaaacaguaauaaagucuuuaaccugccuacacuuucacuuuucauuucuuacacauuucauauccuuuaaacuucaaugcucuccaucuuuacauucgagucaauaaauaauaguauuuaacaacauuaacauuauaguauuaaugauagaacgcuauaaagcaaaauucuaucaugaugugcagugaccacagggaaugguucacucucaggcaggaaugcuuagcagaguucuuuucacauuauguuugcuuuacacgauucuacuuucuagaacacaccuuguagcuguauuucuuuaucaucauaucuuugauagaaacugaaguuaaaaggucuggaacccauucguucagagccacgggccagcauacgugcuccuucucuguagcuugaauaacuacugucuucagagccauuuguaaguucacaaaacagaaaaugcaguaguuuguuuuuguuuuuaaugccuuccaaauuccaacaacaacaacagauuaugugacucagacaccugaaaugcacgccauggaguucggcaggcaggcaguguacauacaaaaccagacacuacuacagaggacuauuuauugaacagaaauagugucuucacuagcagcaaacagcgcccacucacagagaugggcugacuuacagaugagucauuuuccuguguguguguguguguguguguguguguguguguguucauuuaauccaaucaacucauucugcaacaagaagagaacgcugcagggaauuaagguuuccaguagcucuucaugcacugcuuaucucugaaagucaggcucacaccagagucuacggggcagaacgaccaggggugaccugugcuuuaaacauagugccaaugcuggccgcuucgaaauuaucuggaguaaaaucaggacuggaaucucucgccgccuccucgacucaucuucccucacuaaaguaugaaaaacaaaauuucacugcacauuuagaacaaagugcuaauuuuuaucuccuuuaacuguguacuuacaacuacguuaggugaaauggcaugaguucauacaguaaugcugcaugaagaacaccacauucauuacaaggaaagccagaugcuagaggcaagacugcaaagcaaaacaauguugaaaaacagccaggcauguugaugcuacuuauaauccaagcauucaggagacugaggcaggagacucaugaguuuaaggccugccugaguuaaaaaaaauuuuuuuugucucaaaaacaaaacaaaaaauaaacaagaauaacaaaaauccuuaaagguguucccauuccacaucaauaugcauaacaaauguucuuucugcggcucaaagguacaggccaaguauugccaacuaguuuuugugugaauuugacgcaugcaaaagucagucaucugaaauaaaggaacuucaauuaagaaaauaauaucuccauaagaugcagcuguaaagcauuuuguuaauuagugauucaugguggaugguccagcuaauugugugugugugugggggggggguaucgcugggcuggugguccuggauucuguaagaaagcacugugaacaagccagcaggaucaggccaguaagcaacaccccuucauggccucugcaucaguuccuccuuccaggaucuuaccccgauugaguucauccugacuuccuucaaugauaaacaaugaugcaugcggaaguguaagccaaacaaacaaacaaacccuuuccucuccaaguugcuggggucauuguguuucaucacaacaaugguaacccugacuaagacacuuuguaaaugcaggcuggaaucucuacuguuuggaauagcugguacugauuauaccgcaggagauuuaaacaaagggacucauaauuaugacugccaugcugugucuucuaaagcaaaaauuaguacucuagcuucccaggagaagccggcuucuuccguauugauaccauaccaaaggagcacuguuggcuacaauccucgaugccaauuaagauaagacaccagcacauucaguaucuuccgggucacaaaacaauguaaauuuuucugcacagaaaagcuagaccaaaauacaagaaaaguauauccaaucucuuugauugcacauuauuauucaaggauauaaacgacaugagcccuacguaaaaccauuucagaccuugcucugaaacauuucagaccucgcucuguauggcuacucuguauggcuaaaguaguuccuccaguuucugacaccgcacagccgcccaagacucaucgcaaggaaacaccaagggauaaaaaucagagacaaacaaaacggacacaaggcacccuugagaggacacggacauagaaccuauuugagauuagguaccaaggcugauugaucuacauuagagaaucaggaggcuagcuccccaaaggcagauuaaaugccagaaacaaaauaaguuuaucugagagaaagagaagagagagauagaccccuuccccguuuccaugaagauuauuuuaaaaguucaauuaggcuaaaggaguacuucuugucauuacccauccccuacuccagaucugcaaguaggaauccaggagggagauuaaaagaagaauuuaggaaccaaaaccaaagaaaguagucagugugcgccuccaauggaaucuaacccuugugcaugcaaggcaaguggucuaaccacugagccacauacaccucugcccugaagcuuuuacgucacuuuguaaauucucccaucacaaagcccagauugggcagcagggaacuaggcuucaugagucaugcuggucacucuccuucugaauagucuaaggauucacugggguuaccugaagcaguccaagagugugucuucaccacuuuccuacauacacaauggcaaaacgauuccugacuucaacguggcaugcaaacccagcagacuucucaugaauuccgaccuccccaaccgcuccagcucaugagaaucagcucuggcaugcaucgccauacuccucuaucaacagcuagcacuuccaaagaagagacaaugaauaggaccagagcacuggguaugaggguagggcuggcugaguugcuaacggagaccacacccucccgaacucugacuccuucaaccaucaccuaauuacacaaccuucagagguagguccccacucuuugccuauuguccuucaaaguccacuuugugaccuuaagcagacacagguuuccaggcugacucgcaagaugaaauucccuuuaauccauaauccaaucacuaauaauucaggaaaaccuaguauggugcuuugaaugagaaaugucccucagaggcaccuguagguaucagcugauccccaacugguggugcuguuuucugguggccguggaacuuuuaggacacgaggccaugcagaaggagguguaucacuggaggcaggcuuugagacauuauauagccucacccaacuuccagguuacuguuccugcuuccugugugccgcugagaugugagcccucagcucccugcugcuguggccccugcgccucccaacccugauagauucagccugguggaacuguuagcuauugguaugaagaaccuacccuuguuuauuugugugcuuuuugguuuuguuguuguuggagaugggggguuguuguuuuguuuuuuuguuuuuguuuuuguuuauuguuuguuuugguuuuugguuuugaaggaauguaaaaagccucugggaaacuuuggcauacaaguguuaaacguuaccacauaaauggccucuagcucaccucagaaacaucuugaacaccacauucaccaucuaccuuacuuucuuuuuuuuuuuuaaagauuuauuuaucuauuauauguaaguacacuguagcugucuucagucacaccagaagagggcaucggaucccauuacagaugguugugagccaccauguggugcugggauuuaaacucaggaccucuggaagagcaggcagugcucuuaaccacugagccaucucuccagcccucuaccuuacuuucaacaccacugucuucuaggcucgugcaagcaugguccauucaacucugcacauguugggcaaagaauauuaaugucuucuacccucuucuaagagcaugccugagaccaaauuaacaaguaacauacuaauuucuuugguaaauuccaagacagcauaacaccgagucuggagcgaugcuuucucaucacucuagugugggucuaugaugaaaaagaaggguaagaaauacgaaggguacagauuguagggaaaggcacuaguaagcuuacuuaacguugacccugaaacauaugcuggaaaaggugcuauaguuguuaaagagauuagagagaggacugcucggcacaggaauccuggagaguaagggaguaaguggaggguaaggaaggggccgggccccgcccagcuaagcuuccagucuguguaagaaauuuucuaacaaaucuuucucuugcuagaaagcaacugaauaucaaagcugggaauauaguucaaggcugagagucuacugcaagcuggcagugcuguccacgcggggcuagcuuuagaaacgugaaggaugagggggucauagacucuuccucagcagcuuccaagagccaacugcagccagacaacacaaagcagggcuacagucagcgcaagaaggcucugggagaccaagaagcccugaaagguagcuuuguggggguguaaucaugagcuguggaagaccccaggaugcugggauguccucuuacaaggaguuuugcacacugggaguggagccauccaaagagagagauguuugcugcaggcagcaaaagcuggaagaguggaacugccuaagugcuuugaaggcccagauaccagacacagagcuacauaaggaucugcuguuugucuugcuggguuaggggcuuuacuuuaucggucuaucuuuuacuauaucccuguaguccagugccauuuuacauagacauuuaaaaaagaaaaucuaaagauaagagauugcccugagucuaaaaaaaagagacuggggauuuucaacaguauugaaaacuguuagacuuguugaaggagacuuuugaacuuugaacuuggacuaaacacauuuuucaucaugagaugguuaccagucugaaggucaagaguuggaauuugguggcuuaagaaagaaauguccuagagaagcucgcggauuugacacgugagaccacgucgguuguuuagggaggauauggaauguuuuagacugucaagccuugcagagagaagucuguuguugggggcaagguugaaugguuacagucacacccaacucaacagcucacacacccucucugagcucggguuugggauugaggugugaucucucagcuuccuguuccuggcauaauggaccuuuaucccucuggaauuacaauucagaauaaacacuuccaucucuaaggugccucuggucuggcuauuuuaucacagcaauggaaaauuaacacaccuacccaucccuaacauuucuaccauuacuucaguggaaugaaggguggagggagaaagacauucccauguaacuuuaguuaccaccaacuuagucccaggaaauccugaauaucaaaugaaugacauuuuuucccuucuuccaagaacacaacagaagagagggagaaucacuucuacaaaguccaggggaaaaucucacaagaagacacugaccguuaauuuacaggaaauacaaaucaaaaucauaaugacaucaugcuauaugcauuagggaagcuaauauuaccacaugggugucgauguggagaaacuacacaguucuuguguuccuaguaagaaugagaaauggugcacugucaucaaaaacuaucuugcaguugcccagaagcuacacacagccaucaccaucugcucuggcacgccauuccaacacccaaaagagauuuggggacauacauauaacccauguccacaaaagcaccacucccaguaauuaagaaguagaugucacauaacuguccauugagagguagacagccaacaaaaucugguaugagccaaccagggcaaguagauuccauugucauauuguucuuagucaacucuguacaaguagaaagcaaaauagagguugucagaaaacaaggacaggagugggugaguuguuuagcuugcacagaacuuccguuugggaugagaaaguucuggagccaauggacaugucacacaacgcugccaauacaaauaaggccauugaacugcauguucuaaaauggcuagaaggguaaccuucuuauuaugcacguuucuccuuuuguuucuauauagcucaggcuaaccugaaacucaaaauccacugucucugccucccaagugcugagaugacagacaaguuccacagcauucuugcuuuucucacaaggacggaucacaacagucagaauuagggguuccagacaucaacuuuuucagccacacagaacagacuagcuuccccagaaaacugagcugccucacaaacaccucacacauuaaauguuacacuccaagugcuauguacucgccauugugacugaccacugagcgacuacacuacgugcauagaaacuucucugggcucaugagucacauagaaagaauguauuuguaaauaugaaaacggaaauauuuauauuuauugaaguuucacuuuuaagacuuuuguuuuuuagagucaggauuucucauggaaugcuauagaucagaguagccuugaacucagagaucugccuugccucugccucccaugugcugggauuaagggcggaugccuaacauaccuuccuauuuuuuuucuuuuuuuuuuuuaauuagguauuuucuucauuuacauuuccaaugcuaucccaaaaaucccacauacccucccccgcccacuccccuacccacccacucccacuucuuggcccuggcauuccccuguacugaggcauauaaaguuugcaagaccaaugggccucucuuuccacugauggccgacuaggccaucuucugauacacaugcagcuagcucugggugguacugguuaguucauauuauuguucuaccuauaggguugcagaccccuuuagcuccuuggguacuuucucuagcuccuccauugggggcccugugauccauccaauagcugacugugaacauccacuuuuguguuugcuaggccccagcauagccucacaagagacagcuauaucaggguccuuucagcaaaaucuugcuaguguaugcaauggugucaucguuuggaagcugauuaugggaugacaccuuccuauucuucagaccuugacugaaaucccuacuuuaccaaccaacucuaccauuuagcauaauguuuuccauauuuauccuaugucggaacuuucuuauuuuuuuuuuccuucguuuuucaagauaagauucucugucuguagcuuuggcuguccuggaacuugcuuuguagacaaggcuggccucagacucauagagauccacuagccucugccuuccaagugccagaguuaaagacaugccaccacugccugcccagaauuuaaaauucuuauauaaggccaauuauuuucauguuuguauauaucacaucuacuuugaguuacaaaacaggcaaauuauuguagaaagaauaaaauuaccauaguggccagagcaaguuugcuaauagguuuucuuagggaaagugagggagucuauuguuuuccuuuuuguuuuagacaaggcuauagcacaacuuccagacaugagaugaagagauauugagcaagugugucugugucugugucauguguaggaauagaccacauguauagaacagucugcugauaaaugggugacuuccaguaggacuugagaaaucaagguggcaauuagaaacacacuccauauugacuuacaugguuuagaaacagggucuagaucuggaguaaaaaugugagacagaagcccguguugugcccuaagagaaugcaacaccagccccgacacuguuuccagacaaaagucacuuaacucccucauguuugaaaaucccuauucacagccuccuugaccuaagaacaucuuagccacaguuaacuggguaagaauguguaguucugagucuacgaguugucuaaugagcauguuuguauucauucacagagguccagaacaugaccugaacaucacacauguaagcuuucaauaaacaaaacuauacauuaagguuuuccaacuauucauuaaacaucacucagagaaaaauucagaaugauagacaagaaguucaacacaugccgggcgugguagugcacgccuuuaaucccagcacucgggaggcagagguaggcagauuucugaguuccaggccagucuggucuacaaagugaguuccaggacagccagggcuauaauagagcaaccuugucuugaaaaacaaaaagagccggacgugguggugcacgccuuuaaucccagcaguugggaggcagaggcaggcggauuucugaguucguggccagccuggucuacagagugaguuccaggacagccaggacuacacagagaaacccugucucgaaaaaccaaaaaaaaaaaaaaaaaaaaaaaaaaaagaaguucaacagaacaaaacagacauggacucucucuuaagacccaauaggagcugggcaugguugcaaacagaaguccuugauucuggaggcucaguguucuagauugcuuucuacugcugugguaaacaccgaggccaaaagcaagcuggggaggaaagauggcguacacgcccaucaucaaggaaagcuagaaggagaaccagagauggcagaacugaagcagagcccucagaaagcugcuuccuggcuugcucuccauggcuuccuuagcuccacuucucauacagcucaggaccuccugcccauggaugguaccacgcacgguguguugggccuucccacagcaaucauuaaucaauaagauaggccugccuccucccagacuugccugcagguucaaucugaggggggcauuuuuucucaguauagguuccuucuucccagaagaccuaggcuuguguuuaguugacaaaaagcuauacaaaacagcaaccuacggaauggaaaaagauuuucuccaacucugucugacagggcuaauauccaaaauacauaaagaacucaagaaacuagacaacaacaaaccaaauaauccaaucuaaaacaguguacagaucuaaacagaauucucaagagaggaaucucaauuggugaagaaacacuuaaauguucaacauccuuagcuauuagggaaacgcaagucaaaacugcuugagauuccaucuucuaccugucagaucaaugacacguguaacagcucauaccagugaggauguggaacauaaacccuccuccauugcugaugaaagugcaaacuuguaaggccccuauggaaaucaauauggccguuuugaagaaaguucggaauugaucuacuucaagagagagcuauaccauuccugggcauauacccaaagaggcuccaccacaucacaaggacacuugaucaacuauguucaaagcagcuuuauucauaauagccaaaaacuggaaacgaccuagauaucccucaacugaaaaauggcuaaagaaaauguaguucauuuacaaaauggaguaguauguagcuguuuuaaaaaaugacaucaugaaauguauaggcaaguggaaaaaauacugggugagguagccuagacccagaaagacaaacauguacucacuuaugaguguguauuagccaucaaauaaaggauaauuguguuauauccacagacccagagaagcuaaguaacaaggagagaucaaaggggaaccacagaucggagaaaguaaaauaggauagauuucauggguggacugggggcaggugaugagagggaugugggaauggaggaagagaguuuuuuuugggggggggggcuuucgagacaggguuucucuuuauagcccuggcuguccuggaacucacucuguagaacaggcuagccuggaacucagaaauccgccugccucugccuccugagugcugugauuaaaggcaugcuccaccacgcccagcaggaagagaguucuuggacagaugacuggaauuuugggagggcgcacauuuaggggacaagauagaaaccuagugcaguggaaacucccuagaaucuacaagggugacucuagcagagauuucuaguaaugggagauaugaagccugaaccagcaaucuucuguaaccuggaaagacuuccaguggagggucugaaauaccaacccagacaugaaacuuuugaccuacaauuuguccagccuccuagguguacugggguaaaggugguacaguacuugugggaguggucaaccaauaacugguccaacuugagauccaugacaugagagggaauccaugacugacaagugccugcgaggccagcaccagaggcuggguagucuagagacccaggaaaggaccaaacauuucuaaugaucuucuguuauacuuguagacagaagccuagcauaauagucaucagacaggcuucaucuagcaagugauagaagcagaugaagagacccauagucaaacaucagguggaauccugaggaagagggagugggggaaggaauguaggagccagaggggccaaagauaccauaagaacccagcccacagaaucaacaaaucagugcucauaagcacacagacuaaagugacaaccagggagucuauaugggucugaccuaagucuugugcauaagcuguaguuguguagaugaguguucuuguaggacuccuaacagugggaguaggagaagccucugacucaccugcucuugggacccuguuccuccuucugagcugccucauccagccuugauaucagagcuugugccuagucuuauuguaaccuguuaugccaugauaucccugaagaccuguucauuucugauggaaaaugaaggagaaaugguucugggauagagaagagguuuggggggugggacugggagaagagagggggaaacugugguagcuauguaauauaugaaagagagaaagccgggagugguggcgcacgccuuuaaucccaguacucgggaggcagaggugggcggauuucugaguucaaggccagccugguccucaaagugaauuccaggacagccagagcuauacagagaaacccugucucgaaaaaccaugagagagagagagagagagagagagagagagagagagagagagagagagagagagagaugugcaugcacauauacuuacauagcuagagcuaagcaucaugcuaaggcaggaguuuuccugagcacaggaguucaagggacagcauagagauauccuuucucuugacuuuuuuuuuuuaaagauuuauuuauuauauguaaguacacuguagcugucuuuagacacuccagaagagggagucagaucucguuauggaugguugugagccaccaugugguugcuaggauuugaacuccggaccuucggaagagcagucgggugcucuuacccacugagccaucucaccagcccgagauauccuuucucaaaaccauaguaauaauucaguacagagacaaauuguaaucaccauuuugaaaagcaaauucaauaaccagaaaagaaagugaaguuuuguuuaauaauauguaaacuuuuugaauguggauucaguaagucacauacuaguauauuugucuuuacuaccucaaaucagaucuuucucuccauaacacuagauuagagacagcuggccagggucaguacauccaaggagcugaagaacaugcaagucccauucccuaugcacgaccaccuuucuucagguacccagaagcagaaaaggaaagauaagaaugggaccaauguacugagaaauucagaaaugaaaaacaacaaagggaugauugcuuaacuaacuuggcucgugacuaacuuguggacacacaguucuaagaaacagcacacagcccugugacacuuaaccauguuuugaccauucacuugaaucgauuucuauuguuucaguaacucuuaagcaaacgguuaggaauuuaucuuaacaaaaacuuugaacaaaggacuugaaacauagcuuuggacaacugcaaagauuuaaaaauuaaaugauaaaaguaauuauaaauuuuuaaugcagaaacgcaaggaaauacaacuacuuaauaacucugcaauucaugagacaacuggaaaaaaauaccuuugucccacaguuaucaucauguaaaaugcucacaggcacaguacaugggaaauggaagucacccgaugugaacuggggguaggacgacuaugauacugaugcuuuaauuucuuguguauucugaguuagaacaggaugagaaaaccaauuugcaaggguggaggggaaugacccaaauacccaucacugcaaacaauuaaaccaaggcacauccguauaaugaagugccagucaauaaaaaaaacaaaauacugauacaugaauaucuaaaauacaugcuaagugaaagaugccacauacaaaaggcuacgugcuauauaaucccauuuaaagaacagaaucaauguuuguuugggaaaggggguggggagagcugaacaaagagacacaaagaaacuuucuaguuugauggaaauaccuuuguguauucaucugucugugugcaugugcguuuggugauuacaaauacauauauguauguguguauauauacauuuauacauguacacauauacacacacacacacauaucacacacagacauuuaucauuuauaucaaaacucagugaacuuuccaggcauggugguauaggucuauauucucagcccucacaaggcugagguauaauccccugucugagcuagccuaggcuguacagcaagacugcgaugguuuguauaugcuuggcccagggaguggcacuacuggguggagugaccuuggccuuguugaagucguuguggcccugcugucuacaagauguagaccucucagcuccuccuccaccaugcuccugccuugaugauaauggacugaacuucugaaccuguaaaccagacccaauuaaauguuguccuuagaagaguugccauggucauggugucugcucacagccguaaaacccaaacuaagacaaagaccacauugaaagguaagaacaaaggaaagaggggaggaaagaaagaagagagaaaaaagaaaaguagagaaaucaaguccaaggauaauaagguaugccaaaggggugcaaauuuugcuacaugucaauaaguaucaauaaauaagacacugagcuuaguuagaacccaaaccaaggcuucuuggguaccucuaggacauuuucuuucuaaugcugcaugauauuugcuuaugaaauauauuaagcaccaaucuuuggguaagcauuccaucagaaauccauauaagggaagaagauggacagaauauagcuagauuauggcuauagcagaaaaacauguacccugacuauagcaugaauaugagggacagcgaaggccacucugcaagccacacacuuaccucagaccugaggaauagauagcaaaucgcggcuucuaaacgugucauaugucaacagucacuaccuacaagaugcuuaucugaagcuauaguuaaauacuccggaauagugccaucuauuagccaggguucucuagaaaaauagaacuaauaaauuacaagauguauuagauuggcuuacggguuaugauccaauuauuccaacaaugguugucuccagguggaaagucaagaaugcagcaacuauuccgucccgaagguugggcaucucaacuggccuucagugugcucuggaauccugaagaaguggacucuaaauaaacuugcuagccaucaugugggcaaacaaaaagcaaauccucuuccuucccuguccuuuacauaggcugccacaagaagguggggcccaggcuaaaggcggggcuuccuaccccaagagaaguggauuaaaggugggccuucaagccucaaauuauuugaguaacuaaaaauccaaugggugugcccagaagguuggguuuuuaaaguuaguuccagauauaccaaguucauaaaucaaaaauagcccuugccuggggcaaaaggccaucuaaggaggaguccuugagaauggggauccuuaacuguauuauaaccaguaccuaagaagucagagucauuuugagucuuagguacuaaacgauuugcagugccugcacacacugcuaauauucaaaacaaugauuaccaaauauauuuauuuccccgaagagaagauugcccaaacuuaacuaaaucccaugucccauugcuuuucaaagguuugcugauuucuuuucuaugcuuguccaagguuauaaaggaacauacucagagaucccucagacggcuaacccuggcuggcuaagcaaacccucgacacuauggaggccgaguucaaggcacuuccuucacccggucucagguuugcuacuguuucucuccaaaaugucuuuggccaacaacugccggagacucuucucaaaccucccuucuggagcccugacccucccuuagaacucuugaauacugugauuuaacaugaaaguuugcauuuaacagucaccucaaaguaaaugcguccucugccucuggacgccagccaagugucuucucaggugcuccaagguagaucauuugacucagguaggcagggccaaacccacaggaggcagcauuaaaucgccuccuuuccuuuuaccccaaagcaaucaaaauacauccccaaagacauuuuuaaaaaaauauauagcucuacuuguaacuauuucucaccuucucuaauaugcucuggcacaaaccgccccugucugucuccuagacagaaaugucaagcucuuaucuccaugucuccuuacaaaauaugcccuccaccacauaacucaaccgauccuuuugauugcaaugccuuuaagcuuacucauggccucccaccacacucaugauaaaaagggacuggcugacuuuaaacaacaagguucgaugagugccccaccccccacccccaccggcccauguaucaaaaacuuaguccccagacaacaauacugggagaugcuguggcccuucaagacuugggaccuggggugggagggggcauauucuguuauuggagcgggucccuaaaggcauuaugggaucccauugcauuuccuucucuguauuucccagcuugugcucuauucgcccugccuugagcuacugccacaaccuaugacauaccgccaugcgagucagaugugaaaaauaaggggucaccuguuuggggccaggaaccuucaaaaccaugagccaagacuagauuugccaccugaagcauuucauuauaguggugaaaagcugacuaacacaaaccauaauuacccuuugaacuacaggugacaaauacugccaaaggcuaggcacuacugggccguccccaagugagcuuccacugcccacuugcggagccugacauccacggcacaauuccccaucaaucauccacuccuacauccucuccccucucaccuagucagacuuccagcuacucugacagcugggagacaguccuguuucacuggucuugaaauccauacguguucaaaagaaaguauguaccacacagcaccuaaagucuccugagaacgaauguucaaacaucuccucagaaucuuccaucgccagcgcacgggugaaccuuugucuaaacauccuauuguccgcauggcccgaacaaugcuucacuguguccccaggcaaugugagaaaaagacaaguuaacauuucaagcccucacacuuauccugggauuaacuugaaauacaaaagaauuucuuguaaauaagaauccucuagaacuaagccuacuaccguaaaauuaccuaaauauuuacuauuucuaagcucuuuucaaaaauaaaccauucaaacuuucaccucucuuugagaacccggaagggaacacggaggccccgcccccugcacgccagucugugcuugcuugcuuccuuucccagugcgacugcucuguggcagcggguggaucugugccagguagaugcucauuguaagcaaggguuauuuuuaggccaguggcuccucuccgauucuugagcugccccuagauaauccugaggacagucuacagagagaaacccccagcuagcacaagaaucuccuucaggcuccaggggagaacacuccgaagucagccagccagcuuggaugucagccauagcuaaccucccucuacccucagccagccagaccugaggcggggccuccauuucgaaugugcaaacagugccuagaauuucaucaaacacagaucaaagagucauugcucuuggauagagauuccauaccuauaugccaggaaguuuagaccucaacgauaugauacuguuguuuuugagauggcaugucuauuaucaauguugacacacuagccuuggaaaggauauugaaaaugacaaaggucaaagaaaauucuucaaaaaugaaaaacauacuaagaugauguguuaagugauccaaccacuacauuauuuaaaaccacauauuuuuuaucauuucuauuuagaaaaggccuucuagaaaacuaagccugcugccauaccucuauggacgacaaccauaacaagauucaggagaacaagugaaagagcaccagacccagaccacacgcuuguacuuccagcacaugggaugcugaagccgagcugaauccaggcuggccuagauucaccaacccccaaacaacaacacaccaaaacggaaacccacuacccucaaacuacaacuaaauaucuuuguuuucacuuuuuuuuucuuuuugauauguauagguguuuaaccuacauguguguguguaccaugugugccuugacuacauacccuggacuagaguuacacacagcugugagccuccaugggaguguugggaauugaacccagcccucaagaacaaugggugcucugaacugccaagccaucccaccagccugggcacuaagucuuguaacuauaauuucuugggcaauauauccaaauauauggagaaggcguaucucaccaugcgucuuuccuccaagcacagucugaaauaaaaauagccucuucuuuauuccucaucuggguuuuaugaagaacuauguuaacauuuccgaacccacaggucuauaguaucaaaguaugagcucagcauuccuggcccugggguguagcauuugcuucugggagucuggcacugacaucagagcaccuuuacucucucccuaucuggugugcuccacugccucugacgcugggguuuucuucagacugcuaacucugcaaguauucuagaagaacaaaggaaccauggcccucaggaagcaaaauguccagccaaguccacucccuucccuucucacugccucaguaguggcuacuuuuugcaucuguuaaaugggagccggaagugggaaacaacugcuaucuuagaauuaggccuugagagacguggaggaauacaugauagaauaucuuaugaagcaaacguauuuaauauguaugcugugggaauaugagaacaauuugguaauuuagaauggauuuuguugacuggacacauauuucugaggguuuaacucuaagccuuuagcaccauuaaauggucugaguuuagcucuuaguuaugugacagccuuuaaugccacuugacaaguggaagucaaucaaagcguaaaacucaacaacuacucuugaccauaaauccuagacugaaacaacucggagagagggaugcugaaaggccaucucagcuguggccauugaauucugaaaccaccaaggccaaggccacaucaguccuaaucucacacaucugugggaccuagggacaugaaaggucagcucauaauucaaagacagaugaggcaggcagaaaggauccucucucgaggauaggagaaaaaugagcuacgcacccacugagccaccaacuaucuaauauucuaauccccacucaccuacccaccacuaccauccauuugccuuuuagacagaguguucuccauauaucacuggcuguucuggaacucacuauguagaccaggcuagcuucaaacucugagcucacccugccucugacgcuuguaugcugggauuaaagguauggaccaccaccaccaccuggcucaccccuaaccuuuuaaauaaacaauccacacaugccuuucuccggaugacucugauccuguaaaaagauuuuacaucagaacaaacuaacauuucuccuccgagaugcuaauuuccuagccuagcucucagaggagagcuggccaggagaaccaaguggacuuguugagaguaaaacccuucuccacuuguuugcuucuuguaugcagcccagauuggucuagcucuugaugugcuagccucccagcccagccuaagugcugggauuauauguguguaccaacacaccuggcuucauuccccaccaccauauaaauacgauauagucgaaacccagaccaaguccauuucucuagaaguauucucuuaauaaaagaaaucaaccuuaugucacuuguaucacaugagagaaccuccaaucagaaagcugcacaaugacacucagaacagcccugaagggaccaacaauuucuggacucccacaguuccuuuacacaccaauucaguuccuuugcacaacaauucugcccauuuccucgucucuguggcagagggggcuuuuccauacugaagcuuuuauucugucaaaaaaaaaaaaaaaaaaaaaagcuugauuuucuaagacagucccuggcuaggauuggagacacuguagugagugagacacauucaaggagcaaaaauaaauaaauaaauaaauaaauaaauaaauaaauaaauaaauaaauaaauaaauaaauaaaucauucaucauuucaauaaggaaagccagggcguacaaggaaaacauuacagaagcuggaaucguggacaugaccagcgcccagggugccucaggagacguccuggcugugccagaggagaggacagugguagaguagccagcucccuagggaugaggcagugcagugagcccuucgaagccuuuuucaucuccuguacucaugaacugucccuccuggccacaggaggggcgacacaggcauaccagcuuuuaaaccaccguggagaacauguuaaaccaaacucaaccacugccacauuaggaaggacauuuuggcacaaaauggagugcccaacugcagauacaaaguauuccuuuagcuuggauucuauaaacacugacuuaagaaccuaucagucauccugguaaauacgcugcugccaaacacccucagcucacagaccuucauuuagaaccucugagcucaaguaaaaggguaauggaaagcucugaaggaagucucccacccucuagaaauacacagacagagcggaccauacaaggaggccugccuuuggggauuuagagggggcacaugcaagaugaccccaugaagacccagaacucaacaccaauuuugggaucccuuagaaagucacccaccucauauacacuguuuuguaucaggauauauauuucuucuguaaacaaaauaaaaacaauuuuuaggaagaaaaaaaaagauucuuuccuacuucugcucacaagggcuguagaauggggcugaguaggaugugacgcucucgaaugucagaagcaccgagaaaaguuguguaaacacagcggccagcacaccaagggacugacacguugucaguccacucaucagcccaaaggcaguagcaugggaggcagggaccgggacaucagcagcuaccucuuccacagagcuaaugacauccacgugcaggaaagcacacucaagcugauggucccuuagacaaaccaugugacagucacuguccucauuccuccucccauuuauggaagguuaacccagaaguacagacguaaaccaugguagccacaggcaggaaauucaguucagaugugugaagcuuuuuagagggggucuucuuacuaucuaagagggcccugaaccacuccugggcucaagucaugcuccuaccuuagcuuccugaguagcugggaccaugggaauuaaccacucugcccaccucaaaagucuaucucuuuccacaucccucuuaccuuaaccucauccaacacuuggcgagucuguguacguggccacagaccccaaagccaccuggacaagccggcagcuguagugacucuugaggcuaccaaacugugugucugcauuauggucagaggccaacaugcuccuggccucaguuuccuuaccuaugaaacagacucgauccaccucagcacuggucuggagcuaaaagaaguguuuggaaacuuccugaccacuguuagcuacacuacuguaacuuuaacaaccuuguaugacaaacuuacuaaccucacauuucugaggaccagaggcugacaacuuguuuaucuggccagaaaaacuuuccagaguaaaagagguguuuuaaguccugauugcugcauugguuacacaaauauguacucaacaaaacugagagacugggucuugcuauauagaccaggaugaaucugaaaucaaaaucagauccuucugccucagccucuggagugcugagauuguaggugugcaccgacacacccaccacacccacuugaucuccugggauuuaauuuuaucuuaauuuguuuucaaagugcauucaaccaauaagcaucagugggauuuucuggaccguaccuacuacuucauguggggaccucagauuucuuuuuuucucuuaguccucauucucuguaaucuauuuuccagcuaauccuuccuacccacgugacgcacuugaagaauugccucuguucuucuacguauucaaaauucuaagcuuuacugauccagacuggauauuuccaccuugacccuccccuguagccagagccugaaccaaagcaaaccagaaacaccagccaauagacuucugggaaucuaaggcaacaacauucugcaagagccuauugagcaacuagacauguaaaacacccugaguacucagguagaaguacaucaacaaguuucaguuuuuagucuuggggcuaucguaucauguuauaaacaaucuucacaauuucaucaaaacuggccuuuuuaaaauggaagucagaaaacacccgcacuggucgaaacacaucagguuccaaaacaauacggagccaauacagacaugacuguacuuaccaaaguaaauaauucaaaccaagccgagcguacccagugcugaucagguauguucaaaggcuacacaguugggcuugggcaaugacuccuguaaaaaccccuugcuuuuugucagugauaugcacuucauuaaagaaauuaccugaaggcucauuaaggucaaugaggaggguuagcagggcuuaaggcuaaacuaaaaucucuuccugauagugcuaaaugaccgugaacaacuucucagucaggagcucugggcaguugucacggcuuuucaaacuccacuuggcuaaaaggaaauaauuuuccaucuaaaccaugccaagaccaauugaaaaaugucauuuauauauguguaguuacgcaaaccagcaccucaccuuauaccucccaaccuuuauuaaacagcaacuuccuguacccuuuucaugaaaaugauuaccugucagacuuuccauuggccauaaaccaucuugaacacaagggcaacguuggcacacagcuaacucacagugcagccaaaguuagagccacucucuauaaagggccuacuuugaaagucuuaacacuguacauuccucagcaggaacuugaaagacacgaucaucuuuauggccagaagacaugcccgaggcucagauauaacuggggcuauuuggacauuagcgucuuccacuucuagauggcacgagcccucaccuccuaguuaaauuuucacccaggauugccuccucguugcaaucaucuccuaccucugcacagcucaaaaauaaaaggauucggggguuucauagaaaaacauaguccaggaaagucuaccuauuagccuugaguuaacauccaagauguuggagugcuaaucugcaaaaugggaaacaagggauucggauggucauucuuacggaauuguauuauaccuuuuugaaaaagcaaucugaaaacuaccaaauguuauagcaguggaguauaucacccaacacacacaaggccgaaucagaaggcucacugagcuccagaucacccuagucuacacagcagagcccuaucccaagcacuggagacagaaaagaaaguaauaaaaauagaagugaauuugcuguuuuguuucaagacaggguuuccagcugaccuggaacucacuauguagaccaggcuagccucaacugcacagagauccggcugccucugcaaucuauuguuaugagcugcaaccggcaguguugugucaggaaguauuugugaaccccaaaagaccaccaaggaacaguuuccaauguaauagcauuaggguaccucuuuuauuacaagcucuggcuuggguucuccuccaauccaacccugacauagccaacccugacauagaaggacaggaagggaagguggagcagccuggaauccucagcaggacaagguuuuaaaggaaauggaaguaagugggggaucgggggagggggucuauccuggcaagcaucuaacugaaugucuauuguaagcggacaggugggugcucugaagcaagaccauauacaaucacaaacugucugaaaguacaucugaaaccaucagacuaaucuuugacuaccuguugcuaggaaguagcuagggaguaacucucuccuuccugguacgugggugcagcuuggguucugcugcuggucaaguucuaaggcuuuuuuuuuuuuccuugaagauggaggcuggucccaagauggaguaggcuuggccucucauucccacccuucucugguaacuagaaggcccaaucaugggucuuccugaaguuuaucuaaucucaugaaaacaguaacaggucuaugucuuuaugacucagcuaacucaggccuggagguacuggugacuggaaaggacuggaccaucaucaggguucucauuguccaguccuugugguguuccugggccuuggauagggaccccaucagugggagaugggggguaggaggggaguccugagacugaguuuccucccacuggucuagguugucuucaacugaaaacgggucagggauuccauguuguaaucccucaaccuccagggugauaaggagggaucuuucuaaugaggcucuaaugaccccugccuggagggggaccuguuuuauagagaacacgaaguuuaggccaaacaugcuuaugagcccauuggacaccuuugagaucauauagcaacuggugaucuuugaacucagcaaugaccccuaccucuaugucaagaacaauuggggaggggguaucccaaacaugauuucaaaaggggugagucccaucugguaagaagaguuucauaccugguaaagagauaagggaaggagaguuaacucaggaauugccagucucuuaggucucuauuaggguucuguucauucucuaccuguccugaacucuggggucuauaugcaccauaguuucuaaucaaugcccagaauauuggcuagucucugacuuguuugggacacaaaacugguccauuuuuugacccuaucaucugaggaaguccauaccuugacaguauauccuuuaagagcuucuuugucaccguggauguaguuuuauguuuaguggggaaagccucaguccaaucugaaaaggugucuauaaauaucaguaaauauuuauaucuaaauuuuucuagcuuuaccuauaugaagucugucacucaguauacucugggcuuuaugccucuggaccuauuaaugggguucuucucauuagucacugaauuaguuaacuggcugacuuuacuuuucuugacaaucuccgcuaucuucgaguuuggcaucucugauccugauauuagcaaaucccauauucuccagaugcccaugugggaagagaagugaaucuucugaagaauguguaguuccaguucugacacaauggguuugucaccugcuguucucuaccaucucucauaacguugggcaaauuucuacccaaauuaugucaucuuuugaauauuuaagguggucggucaggggauauaggauccacccaauccagagaagucgggggcaaaagaggucugauuucuagggcagcaugacaggcugcuugaucugcccuauugcugcccucugaaacuggauccuuucuucucuggugucuaaguacugaauaaugaucagcuucuuaggaccccacagagcccuuaguaaggagaggauucucgauuuuuguuagucuuuccuucugcugucagaaggccucucucucuacaaauagcaccauggaccucgcuuaaacauucuguuuuacauucugugcuuuuguuuguuugguugauuuuuguuuuguuuuuguuuuucaagacaggguuucucuguguagcccuggcuguccuagaacucacucuguagaccaggcuggccucgaacucagaaauacaccugccucuuacauucugugcuuaaagaauagaaaaauaguuaaagacuaguuaacuuacgcugccuaacuuucacauguccacauaaucuuauaacuuugaucucacuuaaaugccaauauaucgaaugugcuagcaccaguaauucauuacugggaauagcagaauuccacuacaauaggacuguaguggaaggaaggguaagugccaccuucagacaaaaagcuuugguccccaguuuccuucuauauaaaauagcucucaugacuggauauacccaacacacagggcugauaugcucgcuaaauguaaagguucuuaaugugcuuuggguccaagguguuuuccaacagcauggauggaaggcaugcguccccaaaaacguucacgauggcucagaaguuaaggggcauugacugcucuuccagauguccugaguucaauucccagcaaccacauguugacucacaaccauuuguaaugggaucugaucugaugcccucuucuggugugucugaagacagcuacaguguacucgugaacauaaaaauaaauaagucuuaaaauaauaaaaagaaagaaagaaaaagucuucaaucugaacauuuuggacuaaguuaaaggcuaaauaugagaugaugggucuugaguacuuuaaagucaacacauaucauaaguucaaagugaugacuuaauuuuaaguacuuuuagaauguacaggcagcaaaugaacaacaugguuuuacagccuauaugaaagaaggaaguaucugccuugauugaaaagauucagcucaaauguaagaaaaaaccaggaguucaccaaguucaccacucaaaagaaaaccaagaggccauuaaaguggaguccaagaauaaauaaaagucaaauauuccguguaaaccaauuauuuucgaaaaaggagaaagguaucagguucuugugccuggaguuuaauucccacaaaugcaucagcugauccaggcaacaccuucaccaaaccuucgucagggugauuacacauccaccuaugagucagcagauuucagacagacuaggguagguuuaauagcaccuauuggucacgcucuaaguacuuggugcugccauggcauaaccccaaaagacaugcacgaucccucagauaacuuacaaaaauccccuacuaacacagaggaugagagcuaugcauccagcuuuaucugaccagucaguguuugguucccauuacacaugccaugcccguuccagguguucugguucccauaacauuuuuuuuuuuaccaacucuauaacaaaauaggucucuccaagguuuuauagcugcuguugagauagcaaaaccuaacuaacagcggaaauaacuuauuucauuauugcuaauucauaaagaacagaaagagaagccgcacuugccacuaaagaguggcuaagaagcuacuucaugccggguggugguggcacaugccuuuuaaucccagcacugaauuugcuuucauuagaugcucaguuuauagaguccacauguagaaccaagccauuuauauguguaguuggaauuauuuuuuucgaggcagaggcaggcagauuucugaguucaaggccagccuggucuacaaagugaguuccaggauagccagggcuacacagagaaacccugccucgaaaaaacaaaacagaacaaaacaaaaaaacaacaacaacaaaacaaaaaaaaguuuuaaaucaaguucaauaaugagagacucuaaugagcuacagaguguuccauaggaaugaaaaaacuacacacaaaucuuaagugugaucggagggagagaauucucagacugcaaugucaucugcauucuucuguaaauuguaaauaccuagcucucuaaagaggaaaaaaaaaaaaaguccaaaucuccauucaagagaaauggucaacuugugaccgucugcacacauggagacaauaaauuaucacagguggaauuaauucuguaaaaguauuugcacgugggugugccagauguuccgagaguggcuccucguaacuacguaggaacuuuaauaggaaugucugcgucuuccugcucuccgacacuuggcucaaccuaaugaugcauccuuuuggggguggggggagggcuagagaaguagaugaagaaaguggagaaaaauaccaaggaaauaaacaucagacuuaaaggcuucuagcaucaggaacuggggaaagcacccacaaauucccacaccaacucgacuuauuaucccagguugcaucagggccacagaguccaaauacacccagcacuuuaagguuucaacucuauugucaaaacacuuuccaaagguaacguagaacaccauggagagaagaaagaguagccacgguguccaguaaaugucuaaugaggaaaacuacuggccacuacagaauuuuuuuuuuuuuuaagaacuaugugugccgcaggugguggcaccuggcuuuaaucucagcaguguggaggcagaaucagaggguucucggugaggucaaggccaaacuuggucuccauagcaaguuccaggccagucaaguugacacagugauacucuugucucaagaaauaaauaagagaaaagaaauaaggaacuauuuucagggggugggaucuugggauugaaugcaggaucugcagacuuauuaggcaacugcucuaccacugagccauaaauaauacucccaucucaccuuuauccuuuuacuuccaaggcaggggcucacuggcuugcauagccuggccuugaauuuauaauccucgugucucaggcuccugaguaacugggugacuaagcucagcaaagauucuuuagauaccacauuucuuaccaaaccucgcucaagacaacagacauaguuuccaacauaguggagacuauaacaaauuacuuguuaaacaauuuaugagaaugagaguauuuguagcaacauaaauacuaacacacucugagaacugaggccaaaucccuucugaaucucugucccuuuacuuagcaguguucuggcaacagggugagcuccuaauagggcuugaaacuggucaaaacuaaauacagcauuuuaacagcagggauuuucuucgagccuuuuucucuagaauacagcauggaaaaaauaauuccaacuacacauauaaauggcuugguuccacauguggacucuauagacugagcaccuaaugaaagcaagcucgguuuucauagucaagagauccugacucagcccuaucuaacccauucuuuuuucaugucuccaaaccugguuacucaacagcaagcuggaccuccugcaaucccgaguucgaaucuacaggauuaaguuaguagugguaggcaaacaaauuucaacuauguaacaugccuaagaauaagaugaugucaacguaggagucuacuauauaauaaaagguaagacauauauaguacaaguuuagcuaguauucuaguaaauacaacucaaucaguuucacagagaugggggagacaggagggggugucuauguuugaaugauaucucuuagauugcuuaggucucuguuggcgacuauuuuuauuccaccaagcuggcugaguuauguuuuaaguagacacgggguacccacauaaugccaugaaucauuaacaaucaucaaaaaaaauuuuuacaagggcccggagcaauggcucagggauuaagagcacuaguuguucuuccaaaggaccaggguuugauucccaacacccauauggugacuuacaaccaucuguaacucuaguaccuggggaucugacgccauccuuugaccucggugcaaauucaggcaaacacucauauucuuaggauaaaaauaauuaaaaucucaauuuguuuauaguacaagaugagcaaaaugaaaauuaaucccuucccuugugugacagcaaauacugucuaacaucuccuguaaacugcuuaucugaaauaaagugaacaaauguugauuuuuuuccuuccaaauuggugaauguguaaauaacacccaaguuaaauauugccaagcuagcaagcaaugcacaaaaggcauagaagauaagcuaacucccaccaguccagacuuagcaaucacuggcagacacaugguuauuuacaaaagaauguaccuuuacccuuacuuaguccucuucuuguuaaaguauagauacuccccccacccccuggagucuuucucaaggccaauuuaguacacaaaauuucuuagcaugguuucacuggagaucaggguaaccgaucaauccacucucagacuaauacuuccaguauaauaaguucagcaucaagcuuaaaacacaauuucuuuucaagguucaagccuguauuaaaagcacacuaauguauacaaugaccuagaaaucuuuuccaaagcagcucacugaggcucaucagccugcccagucuacacacacacacccauacacauacacacacacacacacacacacacacacacacacacacacacacacacauauacaaugacauaucuaagcaaacaauggcagcuuaugagaaacuuaaaaugacuuuaagauuauauuuagcuucauaaccucaaagcaaaaucguuuuuaaguuaauccuagguaaacugauuggccuuaauagacaaagaguuuguuguguuaacguuccguauguuccuacuucuggacucuggaggcuauuagguaaagcaccuuuagacacagucuagagcaaauuagcucacugucuaggaaaagaaauguugcuguauuuuucuacaaaguaaagauaaaaaccccaaauaugccaucccaaaauacacacuuuuuuuucuuuaucuuggaccaagugaacaagcuaaggcgauacuuugugccauaaugggaaaaaugcccacaagaaagggaagcugauuucaagaaacacugaagucauuucaaaaacuguaacugccaucaacuuuuaugaaauuuggcuuggaaacaaacauuucaaagaaagucacauucaaucccuaauuauacugaaccauccuaagcaaaggauagagacugcacccaaagucugcacgcuugucaagcaggcuuuuauaaaacaagacuucaggcuagcuuagccauuucccagauccucuuuuucuucagaggacaacauauccuggcacuagugcuugcucgcucugucuguaugucuguauauugucugucugucuguugagugucaucuccuuuuauggagacauuuuuggaugcccaaacauaaacccugaacagccauucuuaacucucagcuugguggcacaccccuagggccuaaggacaguaugcaagaaggggggcugaugauaaacuugcucaaggucuucagagacccagaguagagucaagauuccagagcagagcuaucucaagccuucaaagguuuuuuuguuguuuuuguuguuuguuuucgcccccuucaaaaaacauaacuuaaucuauuaauaguguuagaauuugggaaacuuaucaacuauagauuuggacaucaagaaaacacguaucagcaauuccguauuaaacuaaacuacaauaaugaauauuaaaaauaaucugggccaggugaugguagcacauaccuuugaucccaacacuuaggaggcagagucuugaagauuucugagaugggggccagccugguccauagaaacccugccucaaaaaaauggggaaaaaauauggcaaaaauugcaaauggacuauaagagaguagacuuuauaauccccagagccgcaaauuccaaagacuuucaaucccagggauuuacauuuuucucagauuuuguuguuuugauuguauagcaccuaaguuucucagacuuuguuguuuugauuguauagcaccuacauuucuuggcuaagcacaagauuucaggcaccuggcuuuaaucucagcaggguggaggcagaaucugucaguucucugugaggugaaggccaaacuuggucaagagauuucaagaaaguccaaaucaacuaacauuugcuggccaucugaaacucuaaccauuugagcuguuacagagaaaucuuuaaagguauguucucugaacagucccaccagaugugaaaguugcagcucucuguagacuuugacaauuuacuuuuugagacaaagacucauguaaacccagcuagccacacuuuaggcuguagccaacacuggucuugaucuuacugcaucuaccuccccagugcuacaacugcaggcauacauccugagaccuggcuauguagucaugcucuaaccaaccacacaugguccauugccacacagcuacuggauaaggaggagaaugcugucucuuuccaagccaauggcuacuacuugauuuuggaucauacacacaauguuaccucuuuggauaccauaaaaaugcuagguaaggggcuagagagaagagucugugguuaacagugguucuuacagaggaccuuggcucagcuuccaauaacgacaugcuggcucacaaccacauguaaguccaguuccaggggaugugacacccuguucugaccuccaugaacaucagacaugcaugugguacauauucaagcuaaacauucauacacauaaaacaaauuccaaacaaugugaugccaauugaaaaguuucuucaaagacaucucugaacuuuugaguuguuggcucuauugguagcaaagaacacauuaaaauauucaucaaugaauucaaaagcucacagacgacacagccaugcugauaagauagccaaugaauuaaaaagguuucccccagaauacuaggaaacacagaucuguggaguguugucacugaaaagauacaaacauggaaucaucugauagagguuuaaagcacuacaaacaccuagauucaagauugucuugaucauuuucucagcuuuaggguagggcaaggcaagacaugauaagcuuauggacacauucuauggauggguucaacucaagcuuuuagagugauugcagggcuuucuggacagaaagagauaugaaaaaaauguccuaaagauuaaauagaugguuucaagauuccucaggucccaaagaaucaggaaaacccucacccaacauuuauauacaguuucccuaaguguucugaucugauugagugcaggugcauacaaagggcccaaagaggacacuaguucccuagggagcuggaguuacaggcaaucuguaagcuuccugaugugggggcuggaaacuaaacccagaucuucuggaagaagcagacugugccauuucuccaagcccuaagaccguccuaaugacauauaccauucuccacaauuugucauuaacaugugcaaaaggaaaaaaaaauugcacaacagcagcuacugcagaacauagaaguuguagucauaguuccagaagugacagccauaugugguuccuaaacugugacucagaacuacuaaacauccauuuugggaaaaaccaacauguuugacaacacugaaguacacuucuggaagucaacacaucuauaaauguguuuacagggcaaacacaaauugagaaaaauauuugcaguaugaacagauguaugccaacccaacggccuggaggagguuuuuauaaguagaaaaaugccaauaucccaagaggaaaaugugaugcuacacugaaauaaaaggaaaacuaucccgauguaguagcacaugccuuuaaucccagcacuugggaggcagaggcaagcagaucucugaguucaaggccagccugguuuacaggacaaauuugaagauagucaaggcuacacaaagaaacccugucucaaaaugaaaagaaaacaagaaaaggaacuagaaacccaugugggguacuugauaacauuugcaauccuagaaauggaaacauaaauaccaagauugcacucuucaccuauaaagcuggcaauacuacuuccuuuuaaggguguuagaaagacgguaacacaagagccaguucuggucugcuuaguuugacuaaggcguuuuggagaccaaaguucaauauuuuuaaaagaaacuuuugcaccacuaauugugauuuccaaggacuuuauccuaaggaaaccuaccuugcagacaaaauuuuaaaagcgauuaaggguugcaauagcauauuuaauuacaguaacugaaaaugaaaagaucagcuuguaaaacaagguuaaguaaaucgacacguguauagaauauaauguguaacacuuauuaagauuuugaaggcuuuauauaaugggggaauuuucauuauaguuuacaaaggggagaaaaagagaaauggugggauugacucuuauuuuccugaauguaucaaacuguauacaucagcgguccauuccgguugaaaucagagcucucaggguuacuaaucaacaugcuucuuaaaagcuuaauucuuguaacucuaguuuccaaaaagucuacaagaaauuuauccagaauuucacaauccuagcuaaacccuacaaaaauuauccuugaauuccuaacgguuaauuaaaagguacagaccucucccaaacacaauuuguuucccacauaaaucuaguuuuuaaaaggaacaggugaggggcuggggcagcuaucaaugauaauccagguguuugguauauacaaaacucuucgcuccauccauugaacaagggggugggucacggggggggggggccggggcaguggagagaggguucaggugaagaucgauacaacauuuuaaaaguauuuuaaacuaaauucuaugccuuuuuuaaaaaaacagggcaggaacagguuuucuugcauaacuuuucuuaucgauacaguucuugagaaauaaaucuguaaacaagaaguuuaaacacacccacacaacagaguacagauugcccuaaagggauugcuggagagaacggggaugaacuauuuaaacugauaaccuauuuguaaaacauuccuuacagaggucauauguuuagcgggggcccgaccccaccucuuuuuugcccucccacaaguugucuccggauccccggaauccacucccacccccaccgcgcugugauuugauaccuugauugaacuccaaucaccuggcagaacaugaaagcucgcuuuccuccuguuuugccuaagacucugguuuuaagacaaacaaaauacacuggauuuccucugguagaacacaagacaauuuaaaaguagcauuuugcagagugagugccaguaugcaagcuauguuuacaauucaaugugucacuuuuacaagugaaaagugaacagaucacccuaguugggggggggggcgcaaagacuucgcggaaauucgagcuaaguccucuauugaguaaucaauacggcgacccucaacgugggcuuucccuuagaguuuguaagaacccgcaggcugcagggaguaaaacccgcaugaggaccuggggaacugcacuaauucccuuucucccauauuuucugcccugacugcuuagugggaauggaccccggcaagucgcccagccggaagccugaggcugccagguccagagccagaauccagcgcuuggugggcggcuuuccaccgaggaugcaaacuugacaguuguccuuuauccacaauaaacccaccgccucggucacuuucaaggugacagcaacugcagcccgcuguccugcaggagccccgcgggucccacgugagcucagccuccccacuccuccuacuuugaaacccacuaggacacccgccccccuccccggaaagccaguccggucaccgugagugcguugcagucgccgcuccccagcuccucguucuccggagguccccaccgcggccgggaugggcgacggaaugggauccacuccgcgcuugcccgcagagccggggagccagcccuggggggagccacggcguucugcacccucggcggguccugccuuggagacgucuguaccuggggcuugcagaucgaccccaacccgcaccagcacccuggcggccaggcgggaaccgggaaccc

SEQ ID NO: 12418 - RNA, 142816 nt, Mus musculus
ggguucccgguucccgccuggccgccagggugcuggugcggguuggggucgaucugcaagccccagguacagacgucuccaaggcaggacccgccgagggugcagaacgccguggcuccccccagggcuggcuccccggcucugcgggcaagcgcggaguggaucccauuccgucgcccaucccggccgcgguggggaccuccggagaacgaggagcuggggagcggcgacugcaacgcacucacggugaccggacuggcuuuccggggaggggggcggguguccuaguggguuucaaaguaggaggaguggggaggcugagcucacgugggacccgcggggcuccugcaggacagcgggcugcaguugcugucaccuugaaagugaccgaggcgguggguuuauuguggauaaaggacaacugucaaguuugcauccucgguggaaagccgcccaccaagcgcuggauucuggcucuggaccuggcagccucaggcuuccggcugggcgacuugccgggguccauucccacuaagcagucagggcagaaaauaugggagaaagggaauuagugcaguuccccagguccucaugcggguuuuacucccugcagccugcggguucuuacaaacucuaagggaaagcccacguugagggucgccguauugauuacucaauagaggacuuagcucgaauuuccgcgaagucuuugcgcccccccccccaacuagggugaucuguucacuuuucacuuguaaaagugacacauugaauuguaaacauagcuugcauacuggcacucacucugcaaaaugcuacuuuuaaauugucuuguguucuaccagaggaaauccaguguauuuuguuugucuuaaaaccagagucuuaggcaaaacaggaggaaagcgagcuuucauguucugccaggugauuggaguucaaucaagguaucaaaucacagcgcggugggggugggaguggauuccggggauccggagacaacuugugggagggcaaaaaagagguggggucgggcccccgcuaaacauaugaccucuguaaggaauguuuuacaaauagguuaucaguuuaaauaguucauccccguucucuccagcaaucccuuuagggcaaucuguacucuguuguguggguguguuuaaacuucuuguuuacagauuuauuucucaagaacuguaucgauaagaaaaguuaugcaagaaaaccuguuccugcccuguuuuuuuaaaaaaggcauagaauuuaguuuaaaauacuuuuaaaauguuguaucgaucuucaccugaacccucucuccacugccccggccccccccccccgugacccacccccuuguucaauggauggagcgaagaguuuuguauauaccaaacaccuggauuaucauugauagcugccccagccccucaccuguuccuuuuaaaaacuagauuuaugugggaaacaaauuguguuugggagaggucuguaccuuuuaauuaaccguuaggaauucaaggauaauuuuuguaggguuuagcuaggauugugaaauucuggauaaauuucuuguagacuuuuuggaaacuagaguuacaagaauuaagcuuuuaagaagcauguugauuaguaacccugagagcucugauuucaaccggaauggaccgcugauguauacaguuugauacauucaggaaaauaagagucaaucccaccauuucucuuuuucuccccuuuguaaacuauaaugaaaauucccccauuauauaaagccuucaaaaucuuaauaaguguuacacauuauauucuauacacgugucgauuuacuuaaccuuguuuuacaagcugaucuuuucauuuucaguuacuguaauuaaauaugcuauugcaacccuuaaucgcuuuuaaaauuuugucugcaagguagguuuccuuaggauaaaguccuuggaaaucacaauuaguggugcaaaaguuucuuuuaaaaauauugaacuuuggucuccaaaacgccuuagucaaacuaagcagaccagaacuggcucuuguguuaccgucuuucuaacacccuuaaaaggaaguaguauugccagcuuuauaggugaagagugcaaucuugguauuuauguuuccauuucuaggauugcaaauguuaucaaguaccccacauggguuucuaguuccuuuucuuguuuucuuuucauuuugagacaggguuucuuuguguagccuugacuaucuucaaauuuguccuguaaaccaggcuggccuugaacucagagaucugcuugccucugccucccaagugcugggauuaaaggcaugugcuacuacaucgggauaguuuuccuuuuauuucaguguagcaucacauuuuccucuugggauauuggcauuuuucuacuuauaaaaaccuccuccaggccguuggguuggcauacaucuguucauacugcaaauauuuuucucaauuuguguuugcccuguaaacacauuuauagauguguugacuuccagaaguguacuucaguguugucaaacauguugguuuuucccaaaauggauguuuaguaguucugagucacaguuuaggaaccacauauggcugucacuucuggaacuaugacuacaacuucuauguucugcaguagcugcuguugugcaauuuuuuuuuccuuuugcacauguuaaugacaaauuguggagaaugguauaugucauuaggacggucuuagggcuuggagaaauggcacagucugcuucuuccagaagaucuggguuuaguuuccagcccccacaucaggaagcuuacagauugccuguaacuccagcucccuagggaacuaguguccucuuugggcccuuuguaugcaccugcacucaaucagaucagaacacuuagggaaacuguauauaaauguugggugaggguuuuccugauucuuugggaccugaggaaucuugaaaccaucuauuuaaucuuuaggacauuuuuuucauaucucuuucuguccagaaagcccugcaaucacucuaaaagcuugaguugaacccauccauagaauguguccauaagcuuaucaugucuugccuugcccuacccuaaagcugagaaaaugaucaagacaaucuugaaucuagguguuuguagugcuuuaaaccucuaucagaugauuccauguuuguaucuuuucagugacaacacuccacagaucuguguuuccuaguauucugggggaaaccuuuuuaauucauuggcuaucuuaucagcauggcugugucgucugugagcuuuugaauucauugaugaauauuuuaauguguucuuugcuaccaauagagccaacaacucaaaaguucagagaugucuuugaagaaacuuuucaauuggcaucacauuguuuggaauuuguuuuauguguaugaauguuuagcuugaauauguaccacaugcaugucugauguucauggaggucagaacagggugucacauccccuggaacuggacuuacaugugguugugagccagcaugucguuauuggaagcugagccaagguccucuguaagaaccacuguuaaccacagacucuucucucuagccccuuaccuagcauuuuuaugguauccaaagagguaacauuguguguaugauccaaaaucaaguaguagccauuggcuuggaaagagacagcauucuccuccuuauccaguagcuguguggcaauggaccaugugugguugguuagagcaugacuacauagccaggucucaggauguaugccugcaguuguagcacuggggagguagaugcaguaagaucaagaccaguguuggcuacagccuaaaguguggcuagcuggguuuacaugagucuuugucucaaaaaguaaauugucaaagucuacagagagcugcaacuuucacaucuggugggacuguucagagaacauaccuuuaaagauuucucuguaacagcucaaaugguuagaguuucagauggccagcaaauguuaguugauuuggacuuucuugaaaucucuugaccaaguuuggccuucaccucacagagaacugacagauucugccuccacccugcugagauuaaagccaggugccugaaaucuugugcuuagccaagaaauguaggugcuauacaaucaaaacaacaaagucugagaaacuuaggugcuauacaaucaaaacaacaaaaucugagaaaaauguaaaucccugggauugaaagucuuuggaauuugcggcucuggggauuauaaagucuacucucuuauaguccauuugcaauuuuugccauauuuuuuccccauuuuuuugaggcaggguuucuauggaccaggcuggcccccaucucagaaaucuucaagacucugccuccuaaguguugggaucaaagguaugugcuaccaucaccuggcccagauuauuuuuaauauucauuauuguaguuuaguuuaauacggaauugcugauacguguuuucuugauguccaaaucuauaguugauaaguuucccaaauucuaacacuauuaauagauuaaguuauguuuuuugaagggggcgaaaacaaacaacaaaaacaacaaaaaaaccuuugaaggcuugagauagcucugcucuggaaucuugacucuacucugggucucugaagaccuugagcaaguuuaucaucagccccccuucuugcauacuguccuuaggcccuaggggugugccaccaagcugagaguuaagaauggcuguucaggguuuauguuugggcauccaaaaaugucuccauaaaaggagaugacacucaacagacagacagacaauauacagacauacagacagagcgagcaagcacuagugccaggauauguuguccucugaagaaaaagaggaucugggaaauggcuaagcuagccugaagucuuguuuuauaaaagccugcuugacaagcgugcagacuuugggugcagucucuauccuuugcuuaggaugguucaguauaauuagggauugaaugugacuuucuuugaaauguuuguuuccaagccaaauuucauaaaaguugauggcaguuacaguuuuugaaaugacuucaguguuucuugaaaucagcuucccuuucuugugggcauuuuucccauuauggcacaaaguaucgccuuagcuuguucacuugguccaagauaaagaaaaaaaaguguguauuuugggauggcauauuugggguuuuuaucuuuacuuuguagaaaaauacagcaacauuucuuuuccuagacagugagcuaauuugcucuagacugugucuaaaggugcuuuaccuaauagccuccagaguccagaaguaggaacauacggaacguuaacacaacaaacucuuugucuauuaaggccaaucaguuuaccuaggauuaacuuaaaaacgauuuugcuuugagguuaugaagcuaaauauaaucuuaaagucauuuuaaguuucucauaagcugccauuguuugcuuagauaugucauuguauauguguguguguguguguguguguguguguguguguguguguguguguguauguguauggguguguguguguagacugggcaggcugaugagccucagugagcugcuuuggaaaagauuucuaggucauuguauacauuagugugcuuuuaauacaggcuugaaccuugaaaagaaauuguguuuuaagcuugaugcugaacuuauuauacuggaaguauuagucugagaguggauugaucgguuacccugaucuccagugaaaccaugcuaagaaauuuuguguacuaaauuggccuugagaaagacuccaggggguggggggaguaucuauacuuuaacaagaagaggacuaaguaaggguaaagguacauucuuuuguaaauaaccaugugucugccagugauugcuaagucuggacuggugggaguuagcuuaucuucuaugccuuuugugcauugcuugcuagcuuggcaauauuuaacuuggguguuauuuacacauucaccaauuuggaaggaaaaaaaucaacauuuguucacuuuauuucagauaagcaguuuacaggagauguuagacaguauuugcugucacacaagggaagggauuaauuuucauuuugcucaucuuguacuauaaacaaauugagauuuuaauuauuuuuauccuaagaauaugaguguuugccugaauuugcaccgaggucaaaggauggcgucagauccccagguacuagaguuacagaugguuguaagucaccauauggguguugggaaucaaacccugguccuuuggaagaacaacuagugcucuuaaucccugagccauugcuccgggcccuuguaaaaauuuuuuuugaugauuguuaaugauucauggcauuauguggguaccccgugucuacuuaaaacauaacucagccagcuugguggaauaaaaauagucgccaacagagaccuaagcaaucuaagagauaucauucaaacauagacacccccuccugucucccccaucucugugaaacugauugaguuguauuuacuagaauacuagcuaaacuuguacuauauaugucuuaccuuuuauuauauaguagacuccuacguugacaucaucuuauucuuaggcauguuacauaguugaaauuuguuugccuaccacuacuaacuuaauccuguagauucgaacucgggauugcaggagguccagcuugcuguugaguaaccagguuuggagacaugaaaaaagaauggguuagauagggcugagucaggaucucuugacuaugaaaaccgagcuugcuuucauuaggugcucagucuauagaguccacauguggaaccaagccauuuauauguguaguuggaauuauuuuuuccaugcuguauucuagagaaaaaggcucgaagaaaaucccugcuguuaaaaugcuguauuuaguuuugaccaguuucaagcccuauuaggagcucacccuguugccagaacacugcuaaguaaagggacagagauucagaagggauuuggccucaguucucagaguguguuaguauuuauguugcuacaaauacucucauucucauaaauuguuuaacaaguaauuuguuauagucuccacuauguuggaaacuaugucuguugucuugagcgagguuugguaagaaaugugguaucuaaagaaucuuugcugagcuuagucacccaguuacucaggagccugagacacgaggauuauaaauucaaggccaggcuaugcaagccagugagccccugccuuggaaguaaaaggauaaaggugagaugggaguauuauuuauggcucagugguagagcaguugccuaauaagucugcagauccugcauucaaucccaagaucccacccccugaaaauaguuccuuauuucuuuucucuuauuuauuucuugagacaagaguaucacugugucaacuugacuggccuggaacuugcuauggagaccaaguuuggccuugaccucaccgagaacccucugauucugccuccacacugcugagauuaaagccaggugccaccaccugcggcacacauaguucuuaaaaaaaaaaaaaauucuguaguggccaguaguuuuccucauuagacauuuacuggacaccguggcuacucuuucuucucuccaugguguucuacguuaccuuuggaaaguguuuugacaauagaguugaaaccuuaaagugcuggguguauuuggacucuguggcccugaugcaaccugggauaauaagucgaguuggugugggaauuugugggugcuuuccccaguuccugaugcuagaagccuuuaagucugauguuuauuuccuugguauuuuucuccacuuucuucaucuacuucucuagcccuccccccacccccaaaaggaugcaucauuagguugagccaagugucggagagcaggaagacgcagacauuccuauuaaaguuccuacguaguuacgaggagccacucucggaacaucuggcacacccacgugcaaauacuuuuacagaauuaauuccaccugugauaauuuauugucuccaugugugcagacggucacaaguugaccauuucucuugaauggagauuuggacuuuuuuuuuuuuuccucuuuagagagcuagguauuuacaauuuacagaagaaugcagaugacauugcagucugagaauucucucccuccgaucacacuuaagauuuguguguaguuuuuucauuccuauggaacacucuguagcucauuagagucucucauuauugaacuugauuuaaaacuuuuuuuuguuuuguuguuguuguuuuuuuguuuuguucuguuuuguuuuuucgaggcaggguuucucuguguagcccuggcuauccuggaacucacuuuguagaccaggcuggccuugaacucagaaaucugccugccucugccucgaaaaaaauaauuccaacuacacauauaaauggcuugguucuacauguggacucuauaaacugagcaucuaaugaaagcaaauucagugcugggauuaaaaggcaugugccaccaccacccggcaugaaguagcuucuuagccacucuuuaguggcaagugcggcuucucuuucuguucuuuaugaauuagcaauaaugaaauaaguuauuuccgcuguuaguuagguuuugcuaucucaacagcagcuauaaaaccuuggagagaccuauuuuguuauagaguugguaaaaaaaaaaauguuaugggaaccagaacaccuggaacgggcauggcauguguaaugggaaccaaacacugacuggucagauaaagcuggaugcauagcucucauccucuguguuaguaggggauuuuuguaaguuaucugagggaucgugcaugucuuuugggguuaugccauggcagcaccaaguacuuagagcgugaccaauaggugcuauuaaaccuacccuagucugucugaaaucugcugacucauagguggauguguaaucacccugacgaagguuuggugaagguguugccuggaucagcugaugcauuugugggaauuaaacuccaggcacaagaaccugauaccuuucuccuuuuucgaaaauaauugguuuacacggaauauuugacuuuuauuuauucuuggacuccacuuuaauggccucuugguuuucuuuugaguggugaacuuggugaacuccugguuuuuucuuacauuugagcugaaucuuuucaaucaaggcagauacuuccuucuuucauauaggcuguaaaaccauguuguucauuugcugccuguacauucuaaaaguacuuaaaauuaagucaucacuuugaacuuaugauauguguugacuuuaaaguacucaagacccaucaucucauauuuagccuuuaacuuaguccaaaauguucagauugaagacuuuuucuuucuuucuuuuuauuauuuuaagacuuauuuauuuuuauguucacgaguacacuguagcugucuucagacacaccagaagagggcaucagaucagaucccauuacaaaugguugugagucaacaugugguugcugggaauugaacucaggacaucuggaagagcagucaaugccccuuaacuucugagccaucgugaacguuuuuggggacgcaugccuuccauccaugcuguuggaaaacaccuuggacccaaagcacauuaagaaccuuuacauuuagcgagcauaucagcccuguguguuggguauauccagucaugagagcuauuuuauauagaaggaaacuggggaccaaagcuuuuugucugaagguggcacuuacccuuccuuccacuacaguccuauuguaguggaauucugcuauucccaguaaugaauuacuggugcuagcacauucgauauauuggcauuuaagugagaucaaaguuauaagauuauguggacaugugaaaguuaggcagcguaaguuaacuagucuuuaacuauuuuucuauucuuuaagcacagaauguaagaggcagguguauuucugaguucgaggccagccuggucuacagagugaguucuaggacagccagggcuacacagagaaacccugucuugaaaaacaaaaacaaaacaaaaaucaaccaaacaaacaaaagcacagaauguaaaacagaauguuuaagcgagguccauggugcuauuuguagagagagaggccuucugacagcagaaggaaagacuaacaaaaaucgagaauccucuccuuacuaagggcucugugggguccuaagaagcugaucauuauucaguacuuagacaccagagaagaaaggauccaguuucagagggcagcaauagggcagaucaagcagccugucaugcugcccuagaaaucagaccucuuuugcccccgacuucucuggauuggguggauccuauauccccugaccgaccaccuuaaauauucaaaagaugacauaauuuggguagaaauuugcccaacguuaugagagaugguagagaacagcaggugacaaacccauugugucagaacuggaacuacacauucuucagaagauucacuucucuucccacaugggcaucuggagaauaugggauuugcuaauaucaggaucagagaugccaaacucgaagauagcggagauugucaagaaaaguaaagucagccaguuaacuaauucagugacuaaugagaagaaccccauuaauagguccagaggcauaaagcccagaguauacugagugacagacuucauauagguaaagcuagaaaaauuuagauauaaauauuuacugauauuuauagacaccuuuucagauuggacugaggcuuuccccacuaaacauaaaacuacauccacggugacaaagaagcucuuaaaggauauacugucaagguauggacuuccucagaugauagggucaaaaaauggaccaguuuugugucccaaacaagucagagacuagccaauauucugggcauugauuagaaacuauggugcauauagaccccagaguucaggacagguagagaaugaacagaacccuaauagagaccuaagagacuggcaauuccugaguuaacucuccuucccuuaucucuuuaccagguaugaaacucuucuuaccagaugggacucaccccuuuugaaaucauguuugggauacccccuccccaauuguucuugacauagagguaggggucauugcugaguucaaagaucaccaguugcuauaugaucucaaagguguccaaugggcucauaagcauguuuggccuaaacuucguguucucuauaaaacaggucccccuccaggcaggggucauuagagccucauuagaaagaucccuccuuaucacccuggagguugagggauuacaacauggaaucccugacccguuuucaguugaagacaaccuagaccagugggaggaaacucagucucaggacuccccuccuaccccccaucucccacugauggggucccuauccaaggcccaggaacaccacaaggacuggacaaugagaacccugaugaugguccaguccuuuccagucaccaguaccuccaggccugaguuagcugagucauaaagacauagaccuguuacuguuuucaugagauuagauaaacuucaggaagacccaugauugggccuucuaguuaccagagaagggugggaaugagaggccaagccuacuccaucuugggaccagccuccaucuucaaggaaaaaaaaaaaagccuuagaacuugaccagcagcagaacccaagcugcacccacguaccaggaaggagagaguuacucccuagcuacuuccuagcaacagguagucaaagauuagucugaugguuucagauguacuuucagacaguuugugauuguauauggucuugcuucagagcacccaccuguccgcuuacaauagacauucaguuagaugcuugccaggauagacccccucccccgaucccccacuuacuuccauuuccuuuaaaaccuuguccugcugaggauuccaggcugcuccaccuucccuuccuguccuucuaugucaggguuggcuaugucaggguuggauuggaggagaacccaagccagagcuuguaauaaaagagguacccuaaugcuauuacauuggaaacuguuccuugguggucuuuugggguucacaaauacuuccugacacaacacugccgguugcagcucauaacaauagauugcagaggcagccggaucucugugcaguugaggcuagccuggucuacauagugaguuccaggucagcuggaaacccugucuugaaacaaaacagcaaauucacuucuauuuuuauuacuuucuuuucugucuccagugcuugggauagggcucugcuguguagacuagggugaucuggagcucagugagccuucugauucggccuuguguguguugggugauauacuccacugcuauaacauuugguaguuuucagauugcuuuuucaaaaagguauaauacaauuccguaagaaugaccauccgaaucccuuguuucccauuuugcagauuagcacuccaacaucuuggauguuaacucaaggcuaauagguagacuuuccuggacuauguuuuucuaugaaacccccgaauccuuuuauuuuugagcugugcagagguaggagaugauugcaacgaggaggcaauccugggugaaaauuuaacuaggaggugagggcucgugccaucuagaaguggaagacgcuaauguccaaauagccccaguuauaucugagccucgggcaugucuucuggccauaaagaugaucgugucuuucaaguuccugcugaggaauguacaguguuaagacuuucaaaguaggcccuuuauagagaguggcucuaacuuuggcugcacugugaguuagcugugugccaacguugcccuuguguucaagaugguuuauggccaauggaaagucugacagguaaucauuuucaugaaaaggguacaggaaguugcuguuuaauaaagguugggagguauaaggugaggugcugguuugcguaacuacacauauauaaaugacauuuuucaauuggucuuggcaugguuuagauggaaaauuauuuccuuuuagccaaguggaguuugaaaagccgugacaacugcccagagcuccugacugagaaguuguucacggucauuuagcacuaucaggaagagauuuuaguuuagccuuaagcccugcuaacccuccucauugaccuuaaugagccuucagguaauuucuuuaaugaagugcauaucacugacaaaaagcaagggguuuuuacaggagucauugcccaagcccaacuguguagccuuugaacauaccugaucagcacuggguacgcucggcuugguuugaauuauuuacuuugguaaguacagucaugucuguauuggcuccguauuguuuuggaaccugauguguuucgaccagugcggguguuuucugacuuccauuuuaaaaaggccaguuuugaugaaauugugaagauuguuuauaacaugauacgauagccccaagacuaaaaacugaaacuuguugauguacuucuaccugaguacucaggguguuuuacaugucuaguugcucaauaggcucuugcagaauguuguugccuuagauucccagaagucuauuggcugguguuucugguuugcuuugguucaggcucuggcuacaggggagggucaagguggaaauauccagucuggaucaguaaagcuuagaauuuugaauacguagaagaacagaggcaauucuucaagugcgucacguggguaggaaggauuagcuggaaaauagauuacagagaaugaggacuaagagaaaaaaagaaaucugagguccccacaugaaguaguagguacgguccagaaaaucccacugaugcuuauugguugaaugcacuuugaaaacaaauuaagauaaaauuaaaucccaggagaucaaguggguguggugggugugucggugcacaccuacaaucucagcacuccagaggcugaggcagaaggaucugauuuugauuucagauucauccuggucuauauagcaagacccagucucucaguuuuguugaguacauauuuguguaaccaaugcagcaaucaggacuuaaaacaccucuuuuacucuggaaaguuuuucuggccagauaaacaaguugucagccucugguccucagaaaugugagguuaguaaguuugucauacaagguuguuaaaguuacaguaguguagcuaacaguggucaggaaguuuccaaacacuucuuuuagcuccagaccagugcugagguggaucgagucuguuucauagguaaggaaacugaggccaggagcauguuggccucugaccauaaugcagacacacaguuugguagccucaagagucacuacagcugccggcuuguccagguggcuuuggggucuguggccacguacacagacucgccaaguguuggaugagguuaagguaagagggauguggaaagagauagacuuuugaggugggcagagugguuaauucccauggucccagcuacucaggaagcuaagguaggagcaugacuugagcccaggagugguucagggcccucuuagauaguaagaagacccccucuaaaaagcuucacacaucugaacugaauuuccugccuguggcuaccaugguuuacgucuguacuucuggguuaaccuuccauaaaugggaggaggaaugaggacagugacugucacaugguuugucuaagggaccaucagcuugagugugcuuuccugcacguggaugucauuagcucuguggaagagguagcugcugaugucccggucccugccucccaugcuacugccuuugggcugaugaguggacugacaacgugucagucccuuggugugcuggccgcuguguuuacacaacuuuucucggugcuucugacauucgagagcgucacauccuacucagccccauucuacagcccuugugagcagaaguaggaaagaaucuuuuuuuuucuuccuaaaaauuguuuuuauuuuguuuacagaagaaauauauauccugauacaaaacaguguauaugaggugggugacuuucuaagggaucccaaaauugguguugaguucugggucuucauggggucaucuugcaugugcccccucuaaauccccaaaggcaggccuccuuguaugguccgcucugucuguguauuucuagagggugggagacuuccuucagagcuuuccauuacccuuuuacuugagcucagagguucuaaaugaaggucugugagcugaggguguuuggcagcagcguauuuaccaggaugacugauagguucuuaagucaguguuuauagaauccaagcuaaaggaauacuuuguaucugcaguugggcacuccauuuugugccaaaauguccuuccuaauguggcagugguugaguuugguuuaacauguucuccacggugguuuaaaagcugguaugccugugucgccccuccuguggccaggagggacaguucaugaguacaggagaugaaaaaggcuucgaagggcucacugcacugccucaucccuagggagcuggcuacucuaccacuguccucuccucuggcacagccaggacgucuccugaggcacccugggcgcuggucauguccacgauuccagcuucuguaauguuuuccuuguacgcccuggcuuuccuuauugaaaugaugaaugauuuauuuauuuauuuauuuauuuauuuauuuauuuauuuauuuauuuauuuauuuauuuauuuuugcuccuugaaugugucucacucacuacagugucuccaauccuagccagggacugucuuagaaaaucaagcuuuuuuuuuuuuuuuuuuuuuugacagaauaaaagcuucaguauggaaaagcccccucugccacagagacgaggaaaugggcagaauuguugugcaaaggaacugaauugguguguaaaggaacugugggaguccagaaauuguuggucccuucagggcuguucugagugucauugugcagcuuucugauuggagguucucucaugugauacaagugacauaagguugauuucuuuuauuaagagaauacuucuagagaaauggacuuggucuggguuucgacuauaucguauuuauauggugguggggaaugaagccagguguguugguacacacauauaaucccagcacuuaggcugggcugggaggcuagcacaucaagagcuagaccaaucugggcugcauacaagaagcaaacaaguggagaaggguuuuacucucaacaaguccacuugguucuccuggccagcucuccucugagagcuaggcuaggaaauuagcaucucggaggagaaauguuaguuuguucugauguaaaaucuuuuuacaggaucagagucauccggagaaaggcauguguggauuguuuauuuaaaagguuaggggugagccagguggugguggugguccauaccuuuaaucccagcauacaagcgucagaggcagggugagcucagaguuugaagcuagccuggucuacauagugaguuccagaacagccagugauauauggagaacacucugucuaaaaggcaaauggaugguagugguggguaggugaguggggauuagaauauuagauaguugguggcucagugggugcguagcucauuuuucuccuauccucgagagaggauccuuucugccugccucaucugucuuugaauuaugagcugaccuuucaugucccuaggucccacagaugugugagauuaggacugauguggccuuggccuuggugguuucagaauucaauggccacagcugagauggccuuucagcaucccucucuccgaguuguuucagucuaggauuuauggucaagaguaguuguugaguuuuacgcuuugauugacuuccacuugucaaguggcauuaaaggcugucacauaacuaagagcuaaacucagaccauuuaauggugcuaaaggcuuagaguuaaacccucagaaauauguguccagucaacaaaauccauucuaaauuaccaaauuguucucauauucccacagcauacauauuaaauacguuugcuucauaagauauucuaucauguauuccuccacgucucucaaggccuaauucuaagauagcaguuguuucccacuuccggcucccauuuaacagaugcaaaaaguagccacuacugaggcagugagaagggaagggaguggacuuggcuggacauuuugcuuccugagggccaugguuccuuuguucuucuagaauacuugcagaguuagcagucugaagaaaaccccagcgucagaggcaguggagcacaccagauagggagagaguaaaggugcucugaugucagugccagacucccagaagcaaaugcuacaccccagggccaggaaugcugagcucauacuuugauacuauagaccuguggguucggaaauguuaacauaguucuucauaaaacccagaugaggaauaaagaagaggcuauuuuuauuucagacugugcuuggaggaaagacgcauggugagauacgccuucuccauauauuuggauauauugcccaagaaauuauaguuacaagacuuagugcccaggcuggugggauggcuuggcaguucagagcacccauuguucuugagggcuggguucaauucccaacacucccauggaggcucacagcuguguguaacucuaguccaggguauguagucaaggcacacaugguacacacacacauguagguuaaacaccuauacauaucaaaaagaaaaaaaaagugaaaacaaagauauuuaguuguaguuugaggguaguggguuuccguuuugguguguuguuguuuggggguuggugaaucuaggccagccuggauucagcucggcuucagcaucccaugugcuggaaguacaagcguguggucugggucuggugcucuuucacuuguucuccugaaucuuguuaugguugucguccauagagguauggcagcaggcuuaguuuucuagaaggccuuuucuaaauagaaaugauaaaaaauaugugguuuuaaauaauguagugguuggaucacuuaacacaucaucuuaguauguuuuucauuuuugaagaauuuucuuugaccuuugucauuuucaauauccuuuccaaggcuagugugucaacauugauaauagacaugccaucucaaaaacaacaguaucauaucguugaggucuaaacuuccuggcauauagguauggaaucucuauccaagagcaaugacucuuugaucuguguuugaugaaauucuaggcacuguuugcacauucgaaauggaggccccgccucaggucuggcuggcugaggguagagggagguuagcuauggcugacauccaagcuggcuggcugacuucggaguguucuccccuggagccugaaggagauucuugugcuagcuggggguuucucucuguagacuguccucaggauuaucuaggggcagcucaagaaucggagaggagccacuggccuaaaaauaacccuugcuuacaaugagcaucuaccuggcacagauccacccgcugccacagagcagucgcacugggaaaggaagcaagcaagcacagacuggcgugcagggggcggggccuccguguucccuuccggguucucaaagagaggugaaaguuugaaugguuuauuuuugaaaagagcuuagaaauaguaaauauuuagguaauuuuacgguaguaggcuuaguucuagaggauucuuauuuacaagaaauucuuuuguauuucaaguuaaucccaggauaagugugagggcuugaaauguuaacuugucuuuuucucacauugccuggggacacagugaagcauuguucgggccaugcggacaauaggauguuuagacaaagguucacccgugcgcuggcgauggaagauucugaggagauguuugaacauucguucucaggagacuuuaggugcugugugguacauacuuucuuuugaacacguauggauuucaagaccagugaaacaggacugucucccagcugucagaguagcuggaagucugacuaggugagaggggagaggauguaggaguggaugauugauggggaauugugccguggaugucaggcuccgcaagugggcaguggaagcucacuuggggacggcccaguagugccuagccuuuggcaguauuugucaccuguaguucaaaggguaauuaugguuuguguuagucagcuuuucaccacuauaaugaaaugcuucagguggcaaaucuagucuuggcucaugguuuugaagguuccuggccccaaacaggugaccccuuauuuuucacaucugacucgcauggcgguaugucauagguuguggcaguagcucaaggcagggcgaauagagcacaagcugggaaauacagagaaggaaaugcaaugggaucccauaaugccuuuagggacccgcuccaauaacagaauaugcccccucccaccccaggucccaagucuugaagggccacagcaucucccaguauuguugucuggggacuaaguuuuugauacaugggccggugggggugggggguggggcacucaucgaaccuuguuguuuaaagucagccagucccuuuuuaucaugaguguggugggaggccaugaguaagcuuaaaggcauugcaaucaaaaggaucgguugaguuaugugguggagggcauauuuuguaaggagacauggagauaagagcuugacauuucugucuaggagacagacaggggcgguuugugccagagcauauuagagaaggugagaaauaguuacaaguagagcuauauauuuuuuuaaaaaugucuuuggggauguauuuugauugcuuugggguaaaaggaaaggaggcgauuuaaugcugccuccuguggguuuggcccugccuaccugagucaaaugaucuaccuuggagcaccugagaagacacuuggcuggcguccagaggcagaggacgcauuuacuuugaggugacuguuaaaugcaaacuuucauguuaaaucacaguauucaagaguucuaagggagggucagggcuccagaagggagguuugagaagagucuccggcaguuguuggccaaagacauuuuggagagaaacaguagcaaaccugagaccgggugaaggaagugccuugaacucggccuccauagugucgaggguuugcuuagccagccaggguuagccgucugagggaucucugaguauguuccuuuauaaccuuggacaagcauagaaaagaaaucagcaaaccuuugaaaagcaaugggacaugggauuuaguuaaguuugggcaaucuucucuucggggaaauaaauauauuugguaaucauuguuuugaauauuagcagugugugcaggcacugcaaaucguuuaguaccuaagacucaaaaugacucugacuucuuagguacugguuauaauacaguuaaggauccccauucucaaggacuccuccuuagauggccuuuugccccaggcaagggcuauuuuugauuuaugaacuugguauaucuggaacuaacuuuaaaaacccaaccuucugggcacacccauuggauuuuuaguuacucaaauaauuugaggcuugaaggcccaccuuuaauccacuucucuugggguaggaagccccgccuuuagccugggccccaccuucuuguggcagccuauguaaaggacagggaaggaagaggauuugcuuuuuguuugcccacaugauggcuagcaaguuuauuuagaguccacuucuucaggauuccagagcacacugaaggccaguugagaugcccaaccuucgggacggaauaguugcugcauucuugacuuuccaccuggagacaaccauuguuggaauaauuggaucauaacccguaagccaaucuaauacaucuuguaauuuauuaguucuauuuuucuagagaacccuggcuaauagauggcacuauuccggaguauuuaacuauagcuucagauaagcaucuuguagguagugacuguugacauaugacacguuuagaagccgcgauuugcuaucuauuccucaggucugagguaaguguguggcuugcagaguggccuucgcugucccucauauucaugcuauagucaggguacauguuuuucugcuauagccauaaucuagcuauauucuguccaucuucuucccuuauauggauuucugauggaaugcuuacccaaagauuggugcuuaauauauuucauaagcaaauaucaugcagcauuagaaagaaaauguccuagagguacccaagaagccuugguuuggguucuaacuaagcucagugucuuauuuauugauacuuauugacauguagcaaaauuugcaccccuuuggcauaccuuauuauccuuggacuugauuucucuacuuuucuuuuuucucucuucuuucuuuccuccccucuuuccuuuguucuuaccuuucaauguggucuuugucuuaguuuggguuuuacggcugugagcagacaccaugaccauggcaacucuucuaaggacaacauuuaauugggucugguuuacagguucagaaguucaguccauuaucaucaaggcaggagcaugguggaggaggagcugagaggucuacaucuuguagacagcagggccacaacgacuucaacaaggccaaggucacuccacccaguagugccacucccugggccaagcauauacaaaccaucgcagucuugcuguacagccuaggcuagcucagacaggggauuauaccucagccuugugagggcugagaauauagaccuauaccaccaugccuggaaaguucacugaguuuugauauaaaugauaaaugucugugugugauauguguguguguguguauauguguacauguauaaauguauauauacacacauacauauauguauuuguaaucaccaaacgcacaugcacacagacagaugaauacacaaagguauuuccaucaaacuagaaaguuucuuugugucucuuuguucagcucuccccacccccuuucccaaacaaacauugauucuguucuuuaaaugggauuauauagcacguagccuuuuguauguggcaucuuucacuuagcauguauuuuagauauucauguaucaguauuuuguuuuuuuuauugacuggcacuucauuauacggaugugccuugguuuaauuguuugcagugauggguauuugggucauuccccuccacccuugcaaauugguuuucucauccuguucuaacucagaauacacaagaaauuaaagcaucaguaucauagucguccuacccccaguucacaucgggugacuuccauuucccauguacugugccugugagcauuuuacaugaugauaacugugggacaaagguauuuuuuuccaguugucucaugaauugcagaguuauuaaguaguuguauuuccuugcguuucugcauuaaaaauuuauaauuacuuuuaucauuuaauuuuuaaaucuuugcaguuguccaaagcuauguuucaaguccuuuguucaaaguuuuuguuaagauaaauuccuaaccguuugcuuaagaguuacugaaacaauagaaaucgauucaagugaauggucaaaacaugguuaagugucacagggcugugugcuguuucuuagaacuguguguccacaaguuagucacgagccaaguuaguuaagcaaucaucccuuuguuguuuuucauuucugaauuucucaguacauuggucccauucuuaucuuuccuuuucugcuucuggguaccugaagaaagguggucgugcauagggaaugggacuugcauguucuucagcuccuuggauguacugacccuggccagcugucucuaaucuaguguuauggagagaaagaucugauuugagguaguaaagacaaauauacuaguaugugacuuacugaauccacauucaaaaaguuuacauauuauuaaacaaaacuucacuuucuuuucugguuauugaauuugcuuuucaaaauggugauuacaauuugucucuguacugaauuauuacuaugguuuugagaaaggauaucucgggcuggugagauggcucaguggguaagagcacccgacugcucuuccgaagguccggaguucaaauccuagcaaccacaugguggcucacaaccauccauaacgagaucugacucccucuucuggagugucuaaagacagcuacaguguacuuacauauaauaaauaaaucuuuaaaaaaaaaaagucaagagaaaggauaucucuaugcugucccuugaacuccugugcucaggaaaacuccugccuuagcaugaugcuuagcucuagcuauguaaguauaugugcaugcacaucucucucucucucucucucucucucucucucucucucucucucucucucucucucucaugguuuuucgagacaggguuucucuguauagcucuggcuguccuggaauucacuuugaggaccaggcuggccuugaacucagaaauccgcccaccucugccucccgaguacugggauuaaaggcgugcgccaccacucccggcuuucucucuuucauauauuacauagcuaccacaguuucccccucucuucucccagucccaccccccaaaccucuucucuaucccagaaccauuucuccuucauuuuccaucagaaaugaacaggucuucagggauaucauggcauaacagguuacaauaagacuaggcacaagcucugauaucaaggcuggaugaggcagcucagaaggaggaacagggucccaagagcaggugagucagaggcuucuccuacucccacuguuaggaguccuacaagaacacucaucuacacaacuacagcuuaugcacaagacuuaggucagacccauauagacucccugguugucacuuuagucugugugcuuaugagcacugauuuguugauucugugggcuggguucuuaugguaucuuuggccccucuggcuccuacauuccuucccccacucccucuuccucaggauuccaccugauguuugacuaugggucucuucaucugcuucuaucacuugcuagaugaagccugucugaugacuauuaugcuaggcuucugucuacaaguauaacagaagaucauuagaaauguuugguccuuuccugggucucuagacuacccagccucuggugcuggccucgcaggcacuugucagucauggauucccucucaugucauggaucucaaguuggaccaguuauugguugaccacucccacaaguacuguaccaccuuuaccccaguacaccuaggaggcuggacaaauuguaggucaaaaguuucaugucuggguugguauuucagacccuccacuggaagucuuuccagguuacagaagauugcugguucaggcuucauaucucccauuacuagaaaucucugcuagagucacccuuguagauucuagggaguuuccacugcacuagguuucuaucuuguccccuaaaugugcgcccucccaaaauuccagucaucuguccaagaacucucuuccugcugggcgugguggagcaugccuuuaaucacagcacucaggaggcagaggcaggcggauuucugaguuccaggcuagccuguucuacagagugaguuccaggacagccagggcuauaaagagaaacccugucucgaaagcccccccccccaaaaaaaacucucuuccuccauucccacaucccucucaucaccugcccccaguccacccaugaaaucuauccuauuuuacuuucuccgaucugugguuccccuuugaucucuccuuguuacuuagcuucucugggucuguggauauaacacaauuauccuuuauuugauggcuaauacacacucauaagugaguacauguuugucuuucugggucuaggcuaccucacccaguauuuuuuccacuugccuauacauuucaugaugucauuuuuuaaaacagcuacauacuacuccauuuuguaaaugaacuacauuuucuuuagccauuuuucaguugagggauaucuaggucguuuccaguuuuuggcuauuaugaauaaagcugcuuugaacauaguugaucaaguguccuugugaugugguggagccucuuuggguauaugcccaggaaugguauagcucucucuugaaguagaucaauuccgaacuuucuucaaaacggccauauugauuuccauaggggccuuacaaguuugcacuuucaucagcaauggaggaggguuuauguuccacauccucacugguaugagcuguuacacgugucauugaucugacagguagaagauggaaucucaagcaguuuugacuugcguuucccuaauagcuaaggauguugaacauuuaaguguuucuucaccaauugagauuccucucuugagaauucuguuuagaucuguacacuguuuuagauuggauuauuugguuuguuguugucuaguuucuugaguucuuuauguauuuuggauauuagcccugucagacagaguuggagaaaaucuuuuuccauuccguagguugcuguuuuguauagcuuuuugucaacuaaacacaagccuaggucuucugggaagaaggaaccuauacugagaaaaaaugccccccucagauugaaccugcaggcaagucugggaggaggcaggccuaucuuauugauuaaugauugcugugggaaggcccaacacaccgugcgugguaccauccaugggcaggagguccugagcuguaugagaaguggagcuaaggaagccauggagagcaagccaggaagcagcuuucugagggcucugcuucaguucugccaucucugguucuccuucuagcuuuccuugaugaugggcguguacgccaucuuuccuccccagcuugcuuuuggccucgguguuuaccacagcaguagaaagcaaucuagaacacugagccuccagaaucaaggacuucuguuugcaaccaugcccagcuccuauugggucuuaagagagaguccaugucuguuuuguucuguugaacuucuuuuuuuuuuuuuuuuuuuuuuuuuuuugguuuuucgagacaggguuucucuguguaguccuggcuguccuggaacucacucuguagaccaggcuggccacgaacucagaaauccgccugccucugccucccaacugcugggauuaaaggcgugcaccaccacguccggcucuuuuuguuuuucaagacaagguugcucuauuauagcccuggcuguccuggaacucacuuuguagaccagacuggccuggaacucagaaaucugccuaccucugccucccgagugcugggauuaaaggcgugcacuaccacgcccggcauguguugaacuucuugucuaucauucugaauuuuucucugagugauguuuaaugaauaguuggaaaaccuuaauguauaguuuuguuuauugaaagcuuacaugugugauguucaggucauguucuggaccucugugaaugaauacaaacaugcucauuagacaacucguagacucagaacuacacauucuuacccaguuaacuguggcuaagauguucuuaggucaaggaggcugugaauagggauuuucaaacaugagggaguuaagugacuuuugucuggaaacagugucggggcugguguugcauucucuuagggcacaacacgggcuucugucucacauuuuuacuccagaucuagacccuguuucuaaaccauguaagucaauauggaguguguuucuaauugccaccuugauuucucaaguccuacuggaagucacccauuuaucagcagacuguucuauacauguggucuauuccuacacaugacacagacacagacacacuugcucaauaucucuucaucucaugucuggaaguugugcuauagccuugucuaaaacaaaaaggaaaacaauagacucccucacuuucccuaagaaaaccuauuagcaaacuugcucuggccacuaugguaauuuuauucuuucuacaauaauuugccuguuuuguaacucaaaguagaugugauauauacaaacaugaaaauaauuggccuuauauaagaauuuuaaauucugggcaggcagugguggcaugucuuuaacucuggcacuuggaaggcagaggcuaguggaucucuaugagucugaggccagccuugucuacaaagcaaguuccaggacagccaaagcuacagacagagaaucuuaucuugaaaaacgaaggaaaaaaaaaauaagaaaguuccgacauaggauaaauauggaaaacauuaugcuaaaugguagaguugguugguaaaguagggauuucagucaaggucugaagaauaggaaggugucaucccauaaucagcuuccaaacgaugacaccauugcauacacuagcaagauuuugcugaaaggacccugauauagcugucucuugugaggcuaugcuggggccuagcaaacacaaaaguggauguucacagucagcuauuggauggaucacagggcccccaauggaggagcuagagaaaguacccaaggagcuaaaggggucugcaacccuauagguagaacaauaauaugaacuaaccaguaccacccagagcuagcugcauguguaucagaagauggccuagucggccaucaguggaaagagaggcccauuggucuugcaaacuuuauaugccucaguacaggggaaugccagggccaagaagugggaguggguggguaggggagugggcgggggaggguaugugggauuuuugggauagcauuggaaauguaaaugaagaaaauaccuaauuaaaaaaaaaaaagaaaaaaaauaggaagguauguuaggcauccgcccuuaaucccagcacaugggaggcagaggcaaggcagaucucugaguucaaggcuacucugaucuauagcauuccaugagaaauccugacucuaaaaaacaaaagucuuaaaagugaaacuucaauaaauauaaauauuuccguuuucauauuuacaaauacauucuuucuaugugacucaugagcccagagaaguuucuaugcacguaguguagucgcucaguggucagucacaauggcgaguacauagcacuuggaguguaacauuuaaugugugagguguuugugaggcagcucaguuuucuggggaagcuagucuguucuguguggcugaaaaaguugaugucuggaaccccuaauucugacuguugugauccguccuugugagaaaagcaagaaugcuguggaacuugucugucaucucagcacuugggaggcagagacaguggauuuugaguuucagguuagccugagcuauauagaaacaaaaggagaaacgugcauaauaagaagguuacccuucuagccauuuuagaacaugcaguucaauggccuuauuuguauuggcagcguugugugacauguccauuggcuccagaacuuucucaucccaaacggaaguucugugcaagcuaaacaacucacccacuccuguccuuguuuucugacaaccucuauuuugcuuucuacuuguacagaguugacuaagaacaauaugacaauggaaucuacuugcccugguuggcucauaccagauuuuguuggcugucuaccucucaauggacaguuaugugacaucuacuucuuaauuacugggaguggugcuuuuguggacauggguuauauguauguccccaaaucucuuuuggguguuggaauggcgugccagagcagauggugauggcuguguguagcuucugggcaacugcaagauaguuuuugaugacagugcaccauuucucauucuuacuaggaacacaagaacuguguaguuucuccacaucgacacccaugugguaauauuagcuucccuaaugcauauagcaugaugucauuaugauuuugauuuguauuuccuguaaauuaacggucagugucuucuugugagauuuuccccuggacuuuguagaagugauucucccucucuucuguuguguucuuggaagaagggaaaaaaugucauucauuugauauucaggauuuccugggacuaaguuggugguaacuaaaguuacaugggaaugucuuucucccuccacccuucauuccacugaaguaaugguagaaauguuagggauggguagguguguuaauuuuccauugcugugauaaaauagccagaccagaggcaccuuagagauggaaguguuuauucugaauuguaauuccagagggauaaagguccauuaugccaggaacaggaagcugagagaucacaccucaaucccaaacccgagcucagagagggugugugagcuguugaguugggugugacuguaaccauucaaccuugcccccaacaacagacuucucucugcaaggcuugacagucuaaaacauuccauauccucccuaaacaaccgacguggucucacgugucaaauccgcgagcuucucuaggacauuucuuucuuaagccaccaaauuccaacucuugaccuucagacugguaaccaucucaugaugaaaaauguguuuaguccaaguucaaaguucaaaagucuccuucaacaagucuaacaguuuucaauacuguugaaaauccccagucucuuuuuuuuagacucagggcaaucucuuaucuuuagauuuucuuuuuuaaaugucuauguaaaauggcacuggacuacagggauauaguaaaagauagaccgauaaaguaaagccccuaacccagcaagacaaacagcagauccuuauguagcucugugucugguaucugggccuucaaagcacuuaggcaguuccacucuuccagcuuuugcugccugcagcaaacaucucucucuuuggauggcuccacucccagugugcaaaacuccuuguaagaggacaucccagcauccuggggucuuccacagcucaugauuacacccccacaaagcuaccuuucagggcuucuuggucucccagagccuucuugcgcugacuguagcccugcuuuguguugucuggcugcaguuggcucuuggaagcugcugaggaagagucuaugacccccucauccuucacguuucuaaagcuagccccgcguggacagcacugccagcuugcaguagacucucagccuugaacuauauucccagcuuugauauucaguugcuuucuagcaagagaaagauuuguuagaaaauuucuuacacagacuggaagcuuagcugggcggggcccggccccuuccuuacccuccacuuacucccuuacucuccaggauuccugugccgagcaguccucucucuaaucucuuuaacaacuauagcaccuuuuccagcauauguuucagggucaacguuaaguaagcuuacuagugccuuucccuacaaucuguacccuucguauuucuuacccuucuuuuucaucauagacccacacuagagugaugagaaagcaucgcuccagacucgguguuaugcugucuuggaauuuaccaaagaaauuaguauguuacuuguuaauuuggucucaggcaugcucuuagaagaggguagaagacauuaauauucuuugcccaacaugugcagaguugaauggaccaugcuugcacgagccuagaagacagugguguugaaaguaagguagagggcuggagagauggcucagugguuaagagcacugccugcucuuccagagguccugaguuuaaaucccagcaccacaugguggcucacaaccaucuguaaugggauccgaugcccucuucuggugugacugaagacagcuacaguguacuuacauauaauagauaaauaaaucuuuaaaaaaaaaaaagaaaguaagguagauggugaaugugguguucaagauguuucugaggugagcuagaggccauuuaugugguaacguuuaacacuuguaugccaaaguuucccagaggcuuuuuacauuccuucaaaaccaaaaaccaaaacaaacaauaaacaaaaacaaaaacaaaaaaacaaaacaacaaccccccaucuccaacaacaacaaaaccaaaaagcacacaaauaaacaaggguagguucuucauaccaauagcuaacaguuccaccaggcugaaucuaucaggguugggaggcgcaggggccacagcagcagggagcugagggcucacaucucagcggcacacaggaagcaggaacaguaaccuggaaguugggugaggcuauauaaugucucaaagccugccuccagugauacaccuccuucugcauggccucguguccuaaaaguuccacggccaccagaaaacagcaccaccaguuggggaucagcugauaccuacaggugccucugagggacauuucucauucaaagcaccauacuagguuuuccugaauuauuagugauuggauuauggauuaaagggaauuucaucuugcgagucagccuggaaaccugugucugcuuaaggucacaaaguggacuuugaaggacaauaggcaaagaguggggaccuaccucugaagguuguguaauuaggugaugguugaaggagucagaguucgggaggguguggucuccguuagcaacucagccagcccuacccucauacccagugcucugguccuauucauugucucuucuuuggaagugcuagcuguugauagaggaguauggcgaugcaugccagagcugauucucaugagcuggagcgguuggggaggucggaauucaugagaagucugcuggguuugcaugccacguugaagucaggaaucguuuugccauuguguauguaggaaaguggugaagacacacucuuggacugcuucagguaaccccagugaauccuuagacuauucagaaggagagugaccagcaugacucaugaagccuaguucccugcugcccaaucugggcuuugugaugggagaauuuacaaagugacguaaaagcuucagggcagagguguauguggcucagugguuagaccacuugccuugcaugcacaaggguuagauuccauuggaggcgcacacugacuacuuucuuugguuuugguuccuaaauucuucuuuuaaucucccuccuggauuccuacuugcagaucuggaguaggggauggguaaugacaagaaguacuccuuuagccuaauugaacuuuuaaaauaaucuucauggaaacggggaaggggucuaucucucucuucucuuucucucagauaaacuuauuuuguuucuggcauuuaaucugccuuuggggagcuagccuccugauucucuaauguagaucaaucagccuugguaccuaaucucaaauagguucuauguccguguccucucaagggugccuuguguccguuuuguuugucucugauuuuuaucccuugguguuuccuugcgaugagucuugggcggcugugcggugucagaaacuggaggaacuacuuuagccauacagaguagccauacagagcgaggucugaaauguuucagagcaaggucugaaaugguuuuacguagggcucaugucguuuauauccuugaauaauaaugugcaaucaaagagauuggauauacuuuucuuguauuuuggucuagcuuuucugugcagaaaaauuuacauuguuuugugacccggaagauacugaaugugcuggugucuuaucuuaauuggcaucgaggauuguagccaacagugcuccuuugguaugguaucaauacggaagaagccggcuucuccugggaagcuagaguacuaauuuuugcuuuagaagacacagcauggcagucauaauuaugagucccuuuguuuaaaucuccugcgguauaaucaguaccagcuauuccaaacaguagagauuccagccugcauuuacaaagugucuuagucaggguuaccauuguugugaugaaacacaaugaccccagcaacuuggagaggaaaggguuuguuuguuuguuuggcuuacacuuccgcaugcaucauuguuuaucauugaaggaagucaggaugaacucaaucgggguaagauccuggaaggaggaacugaugcagaggccaugaagggguguugcuuacuggccugauccugcuggcuuguucacagugcuuucuuacagaauccaggaccaccagcccagcgauaccccccccccacacacacacacaauuagcuggaccauccaccaugaaucacuaauuaacaaaaugcuuuacagcugcaucuuauggagauauuauuuucuuaauugaaguuccuuuauuucagaugacugacuuuugcaugcgucaaauucacacaaaaacuaguuggcaauacuuggccuguaccuuugagccgcagaaagaacauuuguuaugcauauugauguggaaugggaacaccuuuaaggauuuuuguuauucuuguuuauuuuuuguuuuguuuuugagacaaaaaaaauuuuuuuuaacucaggcaggccuuaaacucaugagucuccugccucagucuccugaaugcuuggauuauaaguagcaucaacaugccuggcuguuuuucaacauuguuuugcuuugcagucuugccucuagcaucuggcuuuccuuguaaugaaugugguguucuucaugcagcauuacuguaugaacucaugccauuucaccuaacguaguuguaaguacacaguuaaaggagauaaaaauuagcacuuuguucuaaaugugcagugaaauuuuguuuuucauacuuuagugagggaagaugagucgaggaggcggcgagagauuccaguccugauuuuacuccagauaauuucgaagcggccagcauuggcacuauguuuaaagcacaggucaccccuggucguucugccccguagacucuggugugagccugacuuucagagauaagcagugcaugaagagcuacuggaaaccuuaauucccugcagcguucucuucuuguugcagaaugaguugauuggauuaaaugaacacacacacacacacacacacacacacacacacacaggaaaaugacucaucuguaagucagcccaucucugugagugggcgcuguuugcugcuagugaagacacuauuucuguucaauaaauaguccucuguaguagugucugguuuuguauguacacugccugccugccgaacuccauggcgugcauuucaggugucugagucacauaaucuguuguuguuguuggaauuuggaaggcauuaaaaacaaaaacaaacuacugcauuuucuguuuugugaacuuacaaauggcucugaagacaguaguuauucaagcuacagagaaggagcacguaugcuggcccguggcucugaacgaauggguuccagaccuuuuaacuucaguuucuaucaaagauaugaugauaaagaaauacagcuacaagguguguucuagaaaguagaaucguguaaagcaaacauaaugugaaaagaacucugcuaagcauuccugccugagagugaaccauucccuguggucacugcacaucaugauagaauuuugcuuuauagcguucuaucauuaauacuauaauguuaauguuguuaaauacuauuauuuauugacucgaauguaaagauggagagcauugaaguuuaaaggauaugaaauguguaagaaaugaaaagugaaaguguaggcagguuaaagacuuuauuacuguuuguugcuuuuuuuuagaaaagauuuuauuuauuuauuuuuuauauauaugacgaguacacuguucagaaacaccagaagaaggccccagaucccauuacagaugguugugagccaccaugugguugcugggauuugaacucaggaccucuggaagagcagucaaugcucuuaccgcugagccaucucuccagccccuuguuucuguuuuuugaaacaauaucucaagcaguuccaacugguccggaguggaauucuccugcuucuaacuugacaaauucugggauuacagcaauauuauagcauuaaaucuauguccccacauugaucauggagauauauugaacgucuuuuuuuuucaacucuauaaccugaguccuuggaacaauccuauuucuuuaugccagaagcaaucaucuagcaccagcuaaugcugagcuaguuaaucuggcaaagagcuaaagaugccuucuguacagagaaugaaaguacugucaucauuacuuuugcuuuuaugacuucuacugcaguugauaaguuacagugucaccuagaaacaucuauguguucuguccaggaaaguucagagaaauuacaauguuucguuggcacagaauccaagggaaaugucuuaguugugugugugugugugugugugugugugugugugugugugugugugcgcgccaagcccagcaucaaauguaucuuaaauacaaauaaaccuuaguauauagcuucugagugagagagagugggagaugaauauauuuuuguugagauaguuuuaauguuuuucuuaaaaaaaaaaagggggggggauauaaaagaguuccucugacauuguugcauuuucuacuuaaaaauucuuaaauguguguuuuaaaaagcagcagauuguuuuccuuuggaugauuaaauaguaucauucucuguguuuuaauaaauuauucauuuuuaacccagaucucucuggcgcucuuuaagcuucaucugaaauggguagugaaccuuuccacccuuuauuguuacacaguccagcccuaaacuuuuauauuaguuuuuuauaaagaaaaggggccaucauguuuucucuaguucaaacgaaagcuugaaauccuuuuuguaccaacaaagaacaugauagauuauuuaugcagcagcuucaagccuacacuaucuucuguagcuuccuucuuuaaauauuaauauaagugaaagaauccuuggaaauuauguuuaauugaacagacauuuauugagcacuugcugugugccgugcugucuccugcguggugcagguuacacagugccgggccuugggagcaugucuggacuuuugucuggauuuccuccccacuacucugucaguucagcucacucguaacaguuuccugccuacugcuugucuccaguagaguaugauugacaucuccgccaaggccaguaccagucugcuccggcagacuccagggccaauaaauagaaucugagcugaucccacuaccuaccccacuuuacugccccugucuccuagaguuucuuccucaagacauuccagccuccccugcacuuuggagccuauccuaugugacuccucugccugcacuacccagcucuguuggacaaagcccccuauauuuuccucugacuucuugugaagaucagcaccccgucagauguccuguucauuacuccuguggccuguggguauuuucccuggaaagcaacuuggcuaauuguuacuguguuucauuuauugccaauccaguguguauguaccuucucuggaaugcagcacauagcaacuaucaaaugcaugcuuuagugucccuaauuguauuuacuaugauaccauaguauucauauugucauuuuacaucuuugacugaauucauauuuugcuccaagauugaaaagcaaagcuaccauuaaucaccuuaggaaauagacucaagaguccacaaccuuccaaaacugugucacuuguuggagaccaacccgucugggaacgcuagacauaaaccuuaagaucugaguaugagugcuugcauuaguagugaugagcagugcucucuggguagagcacuaggccugaggcagcgaggagagauggcuaucaguuuccauuuucuccucaucuuugguuauauagaaucuccugcuagguauuuagccagccaggauggcuagcuaguccccagucuaccuucuuggcaaguauagccacugcuguuagcgugucagguguuagaaacggauuccauaccucuugcuacccugcccggcaaaacacagguaaugcugcucugggccacagauccaagguggcagaaggggagagguagggccugggcucuguggcuaauugggaaaccuaugcaaacacaagcauuccaggauaaccuaugcaaacuucugcaugacugagacaauuugugugucuacccauuuaccaagaguuuucuucugcauuugaaucuaacuagaauuuacaucuuaaguucaguagcauguuuuaugacucuggacaucauagaucucucuggcauggucagguauuuguuugauuuuauuuuaaaguacuuucuuggcuagggguacaguaguucaacaguaacaugccuggcaagcaugcaugauguccuguguuuggucucuucaugaauguuuguaugcauacacguguacuugugcgcgcgcgcacgcacgcacacacacacacacacacacacacacacacacacacacaccccuaaaauggagugaguuucaggacagccagggcuacacagaguaacccuguccuaaaaaacaaacaaaacagaaaaagggaaaaaagauaauucuaaauggagugagcgaagguucuguguugcugucuaacauuuuaaaauucuuuucugucaugaguaugaaauuuagguagauaagcaugguugccuguuugucuauugggguuucauuccaagacuucugggacauaacugaagcccgcaagugguucucagcugucuggauguuguuuauuuccuacauguauaaacuuaugauacagguuacuuuaucaggcaggcguagcaagagcuuagcaguaagaacagaacauuuagaaccauacacuguggcuaaaguuaccuagcauuuaugaauuguacauuucugggauuuuccauguaggcuuuuuuuggaucaaggcugaccauggguaauugaagccacgaaaacgaaaccacagauaaggaaagaaaggaccacuuugucuuuaagagagacuucuacaggagaguggcucgauguucagcgcuuugaagugguuaccuucuguccuucuccugucauguauuuagcuuucccuacauugaaaacaauacacuuuuucuguccaucaacaccauugacgaucaucaauacaucauguuuucauuucuugagcuuuucuuuuugagacugccuuacgacauaguccagccuagccuucaccuugcaauauuccugcaccagcuucccugaugcucaauuacaggucaaaauuuguuguuggaugucuuccuaaacugcuucuauuuuuuuaagauaggguuucucacuggaccuggcacucaguguuuccagcuagacuggcugcccagugaguccccguggccuguuuuuguccccuagcucugggguuuuagguguguaccaccaugucuggauuuauuuuugcaugagucuguccccacagugacacucacuuccucuaacaaugccucaccuccucauaaugugccccauggccaagcauucaagcacaguagucuauggggccauagccuaaucaaucuaccacaccucuguagcuuagaucucaggccuuuuugccugagaagugcuugcuucugaacugggaagacugcuucucugucuuccagacuuagaggcgagccuuugauacuugauccuuugucuuuguugcuggaguuuauuuagcucaccaguuaaaaaaaggagcacaaaaccaugcuuagccuuacuccagucugggcagcucuaccaggucuuuccucaauguguaauuauccuuucuuccucccucccucccuaaaaccaagguaucacuauuuagcuuugacuagccucaaacucgcccaagccguccccaaauucauggcaguccacuugcuucaaccuccugagugcugggaguauagguauggaccaccacauccaucuagaccaucaguguugauguugaagacugguuugugaauaauggagaacuucacagaauguacucagaauagcucuuugagccacauauuggcucacacuguucauucuuuuucuugaguuuuaaagcauuauaaugacagaccuuugaguccaccaggugcaauucagauuucaugauuuauaucaggauuuaagcugggaaugggucuuuuccuaaauuaaauggaauggcgugagcaucugucuaugcucauggagaaaggguggaaugaguaaugacuaaggaucuacuguauccaguauaaaauugugagcugugggaccuuggagacccaggacacggugaaguuggggcaucauaaagacauuaauagggaggauuggacuuacaugaagccauugagauggauggggcagauacccuuguuuuauuggugaagggcagucuccuuugguccuggguguguucucccguaugguauuuuacagagacuuaaccaccaucaacuauaacuuggguucuuguccuuaaacuucauggcuauuuagaguuuuuuuucugggaguuuuucuuucuucuucuuuuuuuuuuuuuuuucuucuucuucaguucuauggucuuugggaccugugcccaacuugaacaggucaacacaucuucaguaaacagggucuuaauucucacacuuaagcgugggucuuucaaguaguccuggaacucgcucuguagaacaggauggccuccagcucagaucugccugccuguacuuccugaguguugggauuagaggcaugcucgaucacugaugggguaguuuuuuguuuguuuguuuguuuguuuguuuacaaagaucucaguguauaauuugagguuuacaguuuacauaauugauaggcuuuauaaaauuggaaaacaaauuugguacagauuuugauuuuuuaaaaaaaaucuacuguaucagauuguugaggugauauuuuauggagguaaauauuacuuaugagagaacugagccaugcugaggugcacuguaauaguaacuucucugagucaaaaaauagaaacaaaaccagaagaaucguacauuuugaugauuguuaaguguagcuggugacuagugccgaugugugacccauuacgccaguccaggguuaugcacacugucuucuuggugccaauaugcccccuaucuuuuugguaaguuguuuuaguagggacacucagacacauucccuuggauauuaucuuauuaucuacagcuauuuuuuauucuacaagagcuggguugagugaacaaauuccagauuguguauuuuacaaaaccuaaaaguacucccacuuugucuuuauagaacuuguuugccaaccuuugaacuaguuaacauggggagacuucucaaacaaaccuggggaagauuuaauaccaggaaaggaguagggagguuguucugcauguagggacucauuucaauaaacugcuggccucuaugaugaaaauacauagaaauuccuuuuuuuuuuuuuuaggcuaucuuagaaacucuuugcuucuuugcuugacugucugaacaccuucuuuguucacaaacaaggaaguuagacuucuccucugucauuuagucaaccaccaaggaauuacugauccaauaguuuuuuuuuccuauuaggcaaguauuaauuuauaaagucuucaucuaguaaaaaauaaaaauaaaaaagaaugacuagagugaccaaagcaacaguauuaucagaauauaaucuaugguaucugugccaaugauauaacagcaaagcgcgcuuacacauacacacacacacacacacacacacauauauauauauauauauacacacacacacacauauauauauaugcacacacacacacauauacacacacacauacacacauacacacucacacaaaaacauacauacacucacauucacaugcauacauacuuauacgcacaaacauacauucacacaauaacacacaaacacauauucguucauacacauacguacacucacucacauacauauacucauacacacauacauucauacaaacauacacacacucauauacaaacacauaaacacauacauucacacacacauauucacaaacauacacauacucauauacauaauacccacucauauauacacacacaaacauacauacacacacacagaggaaaaagucauuuuccaauacaucauuacuugauugcucauuuacugaggcugauguuuugugauuggccauugauccuccagucacugaaguggggaucugggccucccccauucauggucccggcaucuuaccaugcugacacacaagggucucacuuuguucaucugugucaagcccugugggagggaaggagaaugugaaggauucugaguguuauggcgcaagccugggggugggcguguauguaauguccacuuagcucuugucuagaaugcacagcauucacaagaaauggaauacaguaaggaagaggaaaugggcuaaguauccagccagacagccccauuagucaugaaauccacuuuguuuucgagugacaagcaggagccugcccucccuucccauucgguucuccuuuuauucucaggaagcucugaaucccuaaaugacacuggcugaaaggcuguccuucaagacagguauugguauccaucuuaauuugguaucaugugcuauguacaugacauaauucguacgagaaugcuucccuuacucccuuaagucuuuggacaacuguuucuaguucuuccauuccugcguagaagggaaguuugugaccuccugauuugacugauacuggcuaugguuccacagugagcuguuagaagaaguggccuuggcagaccugggucacuguuuuaccagugagcgccuauuuuguggaguucaacuacugcugugagucguguguuguucaaaaguagacaggaaaagauagacgggaaagguagagaggagcaugccugcuccuagguaugaaaaaaagcuuuuaaggaaacugauuuuaugauuuuuuuauaaacuauaauuccgaacugucuuuuuguauuuauauacauuaaaauauggcagcucggguuggagagaugguucaggaguuaagagcacugacugcccauccaaagguccugaguucaauccccagcaaccacaugguggcucacaaccuucuguaaugggaucugauguccucuucuggugugucugaagacagcaacaguguacucauauacauaaaauaaaucuuaaaaauuaaaaaaaaagacaucucauacaugaauagguauaaaauuaaguccuguauggccauaaaauagugaagcuagccuuuguuugaccuacgcaaacacauuucauuuuaaaauuaccacaggaugaauuaaauuggagugguaggaauagacuuggugggcaagaggaauaaagcgugggcugacagcaaagcauccccuggacuuguaggcuaguuagugaaauaccgcacacaaccaagaguugucuaaccugauaagagauucacucacagcugauuagcagcguuggcauuaagauuaagcaguuugaguuggaucucuaaaauuccuuccaggauuaagaaugucagcagucauuaguucaauuacgugauggugguucaaguuuuggggcauuuuuacucuuaguguguaugcacggucuugugucugaguguagccacaccuguacuacugugugcacgcuggaggucagaggacagccugaguguuggugcuugucuucuacuuugggacagggucuccucuucuccaguguguauaccgggcuagcugaccuacgcugacguccguuguacuauagagggucugggaguauaggcaugugcuucugggucugguugacauggguucuggggaauccgaacucuuuacccacugagccaaccgaguuaacccuuuuaaagcugagguuucgaauauaauuaucgcuguuuuccaguucuugauuguuuuguuguuauuugcaagacaagaucacagugcguagucauacuugaaugcacaguccuccugccuagugguuagucaacucuugaccuuaaaaaucuuaagaauauguauuuauuuuugaaaaauacuggaugaacugccuauuguauugccaaauccauaaugagugaggaauuuguuguguccuucccaaguugugcucagagaucucuccuuucagauaauucucuuuccaaagggaacuugaucauugugcuuugcucugcuagacagcgcgacugaaugaaccugagaccgguccccuggguguaagaaugguuugcucccaagguuuggucuugucuuuucugcucuguuuuaauucuguuaaaauucauuuuaacguuaaaaaaaauguuuucaagacaguaacuuugaggcuucuuuaaacuugaggcagauccuauuguaaugguaggaauaugaagacuauuugagucaggugagaugaagucauagacuaugugacuagcacguagucggugaccuuuggguagaauucuuaaaaguaaggaggaaugaaauugguccagagacaguaugcuugugugcauguguauauguaugugugccugugugccuguguuagugagccugcauaugugugugugugugugcacgugccugauauacuugcauguuuuuccucagucacuuuuauuuuuguuuguuuguuguuguugguuuuuaaacucaaaacgagcuagggcucuuacuggccuggaacuccucuucuauuaggccaaacugacuagauauuuaaugggucccucccucccucccuuuccagagccacaccuugcccuccccuucucuccccuccccccaggcucuccccacugcuccuuuuuaaaaaaauuagugucuguguauuugcaugacaccacacacuuuauggacugagcugccuuccacuuuuaacuaccucccgagggaaggaugguuaaccuuuuccuguucauggcuuuaucuucacagucaagguacuucauucacauuguguccuauaaugaauagugucagaugacauuaaacaaaaugcacaggucaguuccuaugucugugauuuauacuuguuaauauguguauugcagagaauacugacacuggguggugguggcagcauacacgccuuuaaacccagaacugaagaggcagaggcacguagaucucuugaguucaagggcagcuggucuacagagcaagcucaggauagccaaggguacacagagaaacccugucuugaaaaaacaaaaauaaauaaauaaaaaagugccagcagcccugggggccgaaacacaacgucugguuuuguuauagccgaguucuuugacuuuaauauuacuuuaauuuucagaggagcugaugagaagucaaagauggcaaugacaucucauuuagugccaugcuagaagagaaaaacuggcagccauuuaaauaacauacaacgugagaauggcgccguggcuucuccagugaugcaucuuuucagaauaaccuaauuuggccauuuauuaaguacauaucuucuaaaaauauuuuuaugcaaucaucuuuuauguacuuuggaaaagagugauggggugauaaaaauucuauuaguugaauuuagugacccuguucauguaggcacauaacuucuauaaucaugcuaaugagcaguuuuguuuacaucuacauauuacagauucucucgaucccuccaggaauuguucuuauaguccccuccugccuaggcaggcauuuccuuuucuuucuuuguucuuucuuuucucauuagcauaagaaacaauggguuuucuuguggcauuuucauacuguaucauacugucuguauccuacuuguuuaucuuugccaccucugucacccccucacccccugcucuuucucuuucaccuccgaugguuugaaugaacugugcccauagguuuaaacauuugaacacuuuguccucccgugguggcacuguuuggagaaaguugaugagcuuuaaggagauguagaucucuguuggaggugccacagggagugagaugagggggaggguguugacauugagaguguguguccucaccccacuuccaguucacucucucugcuuccuauguguagcaaaguuuuuucccucaguuuccaacuccagcugcccgcugccaggcccucccagucauuauggccccuuccuguagaauuuuaagucacaauaaaccuuccuuagguuguuuuuggucaugguauuuuaucacagcaacagaaaaguaacuaaaggagcuggcgagauggcucagaagauaagagcacugacugcucuuccaaaaguccugaguucaaaucccagcaaccacaugguggcucacaacuacccguaaugagaucugacaccugcuucugauacaucugaagacagcuacaauguacuuacauacaauauauaaaucuuugggguagagcgagcagggacugagcgagcagaguggaccagagagagcagagguccuaaaaauucaauucccaucaaccacaugaaggcucacaaccaucuaucuguacaucuacaguguacucauauacguacaauaauaauaaauaaauaaaucuuuaaaaaaauaaaaguaacuaaaaugugacucccucgugucacauuuucuucaacaaucacuacccuucaggaagcccaaagguacaucauuuccugcuucugaaaauggauaaacguuuuugauuucaaaaguuagcuuaaauguauuuuauaacggguugagaaugcuaaucugugggauugauuagcaagaugacucgccaccgagcuugaugacagcuugaaguuugaaagcugguucgcaugugguggaaggagagaagcaacugucacaaguugcccucugaacuguaggaagugcugaggcauacaguacacuccagccugcacgcacacacaguaaacccauguaauaaaaugauaauuuguacuuaauaaaaacuuuaaagaucuuaauaaaaaucccuuuagugaucucuuuuaacuaagaguuagugaaggacuuggcuaauuuacaguaaauauauaaauuauucaguuuccguugugggauucagagcucugaguaugugaguuuagguuaugugugucuguguggaugcaucuguaugugcacacauguugucaaugcauaucuaugugcacacuugcuguugagauaaauacuccuccuugccucugcacgaguagaugcuaacuucaggaugcaugaucagagcacucaaaacuguuggugacaauaccagggccauuggauacugcuucaugguuccuauucugacuuuuuuuuuuuuuuuuugguuuuccgagacaggguuucucuguauagcccuggcuguccuggaacucacuuugaagaucaggcuggccuugaacucagaaauccaccugccccugccucccaagugcugggauuaaaggcaugcgccaccaccgcccugccuauucugacuuuuauacucgggucucuggaguuugaauuuggagcaauaaagauuacaaaguagggaaaucagaucugcucuuaauucagaauuuuauagaucacucagugcccuugucccuaucagauauuucacucacaauucagcaccaugacauuagaagguuuauugcuucuuacaguucuagacagagaguccacaagggcugaaagggccuggccgugggugggcagcuggaguuggaaacugagagggagcacuuugccacacacaggaagcagaaagagugagcuggaaauggggugaggacacacccucucaaauucuccauauuagacuuuuaaucaaaugaauaaaaaaaaaaaagccuggauuuuaaaucuuuaaauuuuaaaagagcgaggggaagaggguaugaagauggggaaagaggggaagagggugugccccccugucccgugcaugcaugccuaaggagagcuugagaaguccguccucuccuuccaccuuaacgugggcucugggcccugagcuccaguccaccagcaaacaacuuuaccuucuuagccaucuucacagccuagauuugagcucuuucuggacaucuuaaaaguuugcuacuaauuauagaauugaguuauuuugaguuuguuuaugguagugugaaacuaggagcaaaauuaguuuagaacauuuuguuaccccccccccaaauugucuccucuguccuuugcccccuaaaacauuggccccucuguccuuucccacacaaacccccaguguacuuugucugugguuuccugguucuggacauuuuuguauaaauaguaaucuuuuuguuuguuuuguuuuucgaggaaggguuucucuauauagcccuggcaguccuggaacucauucuguugaccagguuggccuugaacucagaaaucugccugccucugccucccaagagcugggauuaaaggcgugcgccaccacugcccugccauaaauaguuauguuaauagauagucuuuugaauaacuucuuucucuuaguguaauauuuuccuguugcaacacuguauccauguagcuaaugaaacuuuuuuguuuucauuuugagugugugugcuaaagaguauugugauauaaaaauggacaaguuuuuuuguuguuguuuuugguuuuuuguuuguuuguuuuuguuguuuuuuaaauaucuacuuaccagucgauggacuuggguuuccccuacccuuauuuuucagcuuuugugaauaguguuucuguuaagauuguggguuuguuuuuucuguacucuaagcgggaggggaggaccuucagguaucucuucucagaaggguagcaacucugguggguaagcccucuucccuuaugcuguuauuuaacccuucucaugucuuuaaugaccuaucuccagacucagucuccaguauauagucaaaccugagggaugggguuggcuucaauguaugcauuuauuuggaacuguuacacagcacauagugacuuuguuuauauuuugaggaaccucuaacagaggcuauuuaacucucuuugcuuguuuguuuuucaaggcaagguuucucuguauaugccuagcuguugaggaacuugcucuguaaaucagguugaccucgaacucacagagauccacuugacuccggagugcugggauuaaagaugugugacaucuccgcuuggcuuacuucaaaucuuaguaucguucucccccccccccccauacacacacacuugggaagggcacaugguuaagauaggaaugauuuagaaugacuagagaaaugcaaauucuccaagucuguuuaacucauuuguggggccuggauggucuccccggcaaccuugcagaguaggagcccuucugacagugagagggacacguaggaauuuugcugggacaguggacauaaauugggauugccaagggaaauuaggaugaauguuuuuaccguugagcaguaagaaggaaagaugguugcacacugagcuaguucccuucucuaagaagucucugggagucgaagaugucagcccgugacaucaguaggaaacuuuaucugcauuuccaaaccaaaccaucacgcuccauuccuucacacaucaaaaggcuucuuugaaagagagugguaauuagacguuguuguuaaacuaauuaaggagugagcuguaaauuuuucuaacauuuauuugaguuuacuguuuugcuucuuccagggaacgacaagucauuucagcuuuggagcaucucagacuacaguuguggaagccggcugaaagcaauagaaaggggaggagcuggaccauuuuucauuuacucucauuaaaaaggaauuugaagagaagauaaaauggcagaguuuugagguuaauauucaggaugaaugaugauaauucagauaggacagaagauggaucgcguuauguauuuauccgagauaaaaacucgaauccaucugaauacuaccaaacaucgcuaucugcccagugcccuucagugagucacggggauuggaacucugacaacccagaugccaugguggucgauuaugaaauggauccugcgguggacaguagugaaaguguaucuuuaagccaucaguguguugaagaacuugcuuacccagagccuucaagugauuucauggggaagcaugaguuuacaauguacagugagcuuaccugccagucuccugcacuugugaacacagggaagccccaagaccugcacaguaacugugacucccuagaggcaauccaggaugagaaguuugauccccuuaagcccugugagugcaggucugaugacgauuaugcuuguggagauuccccugaaguuuuggagcuaaaacaaacauauggcaugaaaguggacacggcuaacuacaccuuuauagcacgccaugauauugaacagggucagccuuugcaugcuccuggagguuugcagacaacagugagagacagaaaugcuuuguccuccugcggucggacaccaccccauuccucuaagauguaugugagagggguuaauuauaaucgagagaacuuugaaaaccuccaagccacaccauccaagacccuaaacacaaccuuuacagugaucucugaugugcugaugcaaacugacaguccagacguuggaguucagggucagaauucuuuaggaaaugucaccaaagaguacacagaugggacaaggcgaggacucauuggagaaaaagagauacaagcugugacacugguuucggauggcauggagguccccaacggaucugcaucacaggaguucuauuguguaucugaagaugacccaaacagugagacacauucacacggcccguaugcucaacaggaaaugggccaaaauuuaagaggaacacugcccaacugucaugucgauggugaaugcccaguacuggugccagcuuuugagaagaguaaaaccagaguccugggcucugaguguaaagucacugugacugaagacccacacaucgauucccacgacaaugacucagacauccaaaguaguacugaagagcugacccugagaaguguuucagggcagagggguucaccuuaugaaauggguuggggcgagaacggcggagccauuugcacagauaaagcagguugcaugucaacaccaguugagcaaccccccaaucugagcuucagacuugaaccugcugaagugaagaaguacaauaauguggagaauggaccaagagaugcuaaacgugcaccaaacuugaaaggggaaccaacaaauaugccaaaaccuaauuugggaaaaucagcuaccaaaacaaauaccacuguaggcaguaaagucaggaagacagaaauuauaaguuauccuacaccaaacuucaaaaacauuaaagccaaaguuauauccagaucaguguugcaacccaaagacacuuccauaaugaaggacacacccagcccucagguaacagggggcucuucaccaucaccagggccuucuaaacacuugacaaugaugaacaaagcaccaagaucugacuuuaaagccagcaaaaaagcagaaaucccaauuaacaagacacacaagcaacaguuuaauaaacucauuaccagccaggcugcgcaaguuacaacucauucuaaaaaugcuucacucgggguuccaagaacaacaucugccacgaaaucgaaucaggagaauguugacaagacagguucuccucaugcagggagugagaccgggucuguagcugccuucuuccagaagaucaaaggcauucuccccgugaaaaugaaaagcucagaguguuuggaagugacuuacguuucccacaucgaucagauuagcccugaaaagggugagcaggacggugaggcucccauggaaaagcaagagcugggaaaacaagccacgaaugagauuuuugaauccaagucucuauuggugguaagugaacucugcaguuugcuuuuaggaccggugaagaaaaccacuguauuagcaaugaguggccuguaauugcuaauaauaucccugaacuugguucguaauuuguagucagcuguucuuuguucugccaggcaguauagagugugaaugagucaaaauauaacuaacuugcauauuaaaaaaaacccucagauuugguauuuucuugaacguggguguuccuucugauaggguuuuaaaagaguaaauuaauauuuuuaugauauuuugauauuugcauugaaauaacugacacgauuagguuguguguuguuuuccugaaauuaaaaaaaaaaaagagcuuuaagcauucaaacauauugagacacauuuuagaaauggcuagguagugccuguaaacauagcauagcaacauggaaauccaggaagccaagacgcuuuucaaagcuugaguguacuucugaccagcucugugacauggggucagguaacuuugccacagccagaagggaaaggauugugcagugggucuguaaggucaccuguaggucaccugcagugacuucuaaugcaugaaagaaacaaaaguccuuacauaguaaacaaagcaguaugucugcagcaguaccugacgaauccugaggaugagggacuagguagagucacuuaaaaaaaaaaagaagcaauauucgcaguucaaggguuauuuuucuuuaaacaugugcaugucuuuugacaauuguaugauaagauguuuucaaaacauucucggggcugcuguuggcacugccuguguguucucagcucuauuuuuggcaguggagacuaagguguauuuucagccccacacagauugcccuugaaaugcuuguccucuggacccggaauggaucugcugcagaggcggaagacagaugcagugcacacagccugucuuucggggacgcuuguguaggaggaauaaaacagagcauagucaaguacacgagaccuuuuuuuuuuccagguaacauaguaggucacauaggugugugcucaaugauaagaaaacacuggagauacguuugaccugggucauuuuacagauagauguuuuggcuuuaucaauaacuguuggcaaggaugaaauguuacaggguuuucuaaaaugggcuuguguauuguuucaugacacagaucuuucaaguucuuuuuuaugucugaggaagcugauaauuuagaaucuaaauauuuuaccaaauacaauuacaauaaacucuucauuguaaucaauagccuuagguguuuauagaccuacacagaaucaagauauucuuuucauuacuuuaugggaaguuguucuugcugugagacaggguauccacauucagccagccuggcuuugaauucagcacacaguagccuaggccggccuugaaucugagguccucuugcuucgcacccuuagugcuaagaauaguuuuguacugccaugucuaguuuuaugagagacguguccuggcugucacccuucaguaucgggaaaaccagcaugaagucccuugagcacuggucuugaaaauaaguugcuuguguaguucugagacuggagaguuucaguuuuauuuuguuuccuuauauuuccaacuugguagcugugggcccaugauguguauguacuauugaagguaaggccauggaaucguuggguaagguggauuccaacaguuugcaccuagcaguguugcaguaagagcugagaauuagauaugaagugcuuuguaaggcuguaaggaccaucccaagggucccacggugucaucacuggcgauuuuacuuaucagcuagaguauagagcuaugcuucugugaccaugucuuuaauacagcagaguauuugucuaauuuguccaauuugucuaauucaacuaccacccuuuuuuuucuaucuugaggggggguaaagaggcuagcguaaccaucauagccacaggcuaugacuuaguguaggauacuaaaccggugaccucacauugcauuuucuauugaucacuucaguaguaccuaagagcucuaucugccauagaagaauggcuguuuuguuuguuuucuuguguacuccguaggucuuaguccuuaauuaaauuaauuuaucaagacugccgaccaccuuauggcuaugugguggucccaguuuaccugaaacuuuaagaaaggauuuuauuugggagaagugauuuugacuuggauugcuguuagggugagaaguaacugcuuacugcaaagguuauguggucaggauagcaagaugaaggagcugguacugaaaggaaccauggcuuaggugcuuucuuauaggcugucauuaaauuguuacaguaacgcucagggcuuauacauuguauuuauuuguuugcaauuguuauccacacacucaugcuucagaguauuuauuuaaaaacucacacagggggcuggagagauggcucaggaguuaggagcacugacugcccuuucagagguccugaguucaauccccagcaaccacauggugacucacaaccaucuaugaugagaucugaugcccucuucuggcaugcaaauguacaugcagauugagcacuuauaaauaaaauaaaucuuaaaaaaauaaaagaaaauaaaauaaaacgcacacagcuguuggauguucaaacucaggucccacaggucucacagacuucaaauuuuucaguaugugggcacuggagguaaaacaagugauuugugggagauucacuucuauaaguugauguuugauuuacuuuuuucaagaaaguuuuucuagaagauucuguuuugcuuuagugucauugugaccugcagcaguucucuuggaaacacuagcuauuggaauaguauaugaauucaauagauacugguguuagggauauacacaauaauauauaaaacaauaacuaaacaaaggagcacacagaagggcauaugcaagcgugaacauggauuuuggauaacuuuaaauguguggcuuuaccacucacugcaaaguggccucucucugaggcucaguuguucucuuuguaaagagagaagguaauuguacuuuauaguguuagaagcugguuguacuuggagucagagccaggcuccuguucccuuaugucuacaguggaaacaauuguugggcaucuacuguguaugccacagaugguaguacuuguuaggguaucaagaaagacagcuaugguccaauguuuuaucuaaugcaguguuacugucagaaaauaagccauaagggcaugcuaaguacugagucaggaguguggauggcgugcuguguacuggaggaaaggcugguagcaguugggagggcuaucaagagaagaaagcuucugaugacgaggccauuuagucucuggcuguagcuuacagggcuugugugcugggcugagaaaacaccaaguguuaagaugaagagcacagggauguauucugaugcaagcaugccagguucagguagagguugugaugggagaggggaaugcaaggagacaaugacaguggauuugcugugacuuuaaaagaguugaguuuuuggaagauuuuuguaguaggggaguagaagaagcagaggcuggggagaccagacaagccucaaggacaugauuucagcaaucauuuugagaaaugaggcuggcuuuuuuauaugaaggcagguagaaaaauggguucaagagccaagaaaagcagcaaagacacaugucuuaguuaggguuuuacugcugugaacagacaccaugaccaaggcaagucuuauaaaaaacauuuaauuggggcuggcuuacagguucagagguucaguccaagaucauuaaggugggagcauggcagcguucaggcaggcauggugcaggaggagcugagaguucuaagucuucauccaaaggcugcuaguggaagacugauuuccagguaacuagggugaggaucuuaagcccacacccacagugacacaccuacuccaaccaagucacaccuauuccaacaaggccacaccuccaaauggugccacacccuaguccaagaauauacaaacccaucagaacacacaacagcuuuccuuguuuaaguuggguagcuggauauguuaauaggagacagguguaaauugugaacuugauuuuuuuuuaaaguguuuuaaugcuauuccuuaaaaugggguaugaccaauaaucuuacuagguuaaaaacagauuuaaagccgggccugguggcgcacgccuuuaaucccagcacuugggaggcagaggcaggcguauuucugaggccagccuggucuacaaagugaguuccaggacagccagggcuauacaaagaaacccugucucaaaaaaccaaaccaaaacaaaccccccccccaaaacagauuuaaauuaguugaugcacauguuuagauuuuaaauuaguugaugcacauguuuagauuuuagaauggagagccaccauagaccuaucuguacuucuggggugaugguugaaggaaugcaagucagccugaccacagagagaaccacagcauguuuacugcuucaauauucacagugcccaucuagggaaccagcccagauguggaucagcagaugagcugauuggagcagugguacaggugcacaaagcaacuuaacucuucuguaaaaauuaaugaaauugugucauuuauaggagaauuaauggaacuugaaaucgcacuaaguaagucagacucaaaccacauauguuucuuucauaugcagaaucagucucuuucugccuuuaauuuguuuguguguguguauguguguguguguauauauguguguguguaugcguguauguguguguguguguguacacauauaaauauguguguauucaggaguguacaucuugaaaauagagugacugugacauagaagagagaucuaagaaaaggaaaaaucaggagcaaaagggaugauaaagaagaccagaaaagaaaaaaaucccauguuuugucucauaugugcuaggucaaguaucuauauggaggcguauguauacauaugcacacauaaaugugacauaaaaguagaaggcacggggcugaccagauggcucagcggguaagagcacugacucuuauauacauaaaauaaauaaaucuuuuuuuuaaaguagaaggcauauuuugauguaggaggaaagaguugggaagauggauaagggcuagugaaugauugaauagaaagaaaauaaaaacuguauaugugaugggcaugguggugcacgccuuuaaaccuagcacuugggaggcagaggcagguggauuucuggguuugaggccagccuggucuacagagugaguuucaugacagccagggcuacgcagagaaacccugucucaaaaacaaaacaacaacaacaacaacaacaaaaaacuguauaugugcaaaacugccacauuuuguaugaccuacaauaucauuauuuuguaagcuagcuaaaaaucaaaauuuagaauggcuuuuuauguaguguaagggcucuguguuagugagugccaauaauaauaggguaauuguuauugaguagaaagaucucaguggggauauucaggggcaacugaagggggagaguguuggcuuggaaauaugacuuuugagugcaucauucaugguugaaauacaagacaagcuaugaagggcgagcucauggggagggaagauaacaagaccaaguugaagcccuggcucagacuaaccuugaaagguaucaaagaaugaggccuagggaagaaauaaccagacagcuacugggccuaaagguauaucagggccauugaagucagcuucaaggagucuuacucuuuuuuuuuuuuuuuaacauuuauuuauuauuauaucuaaguacacuguagcugucuucagacacaccagaagagggcaucagaucucauuacggaugguugugagccaccaugugguugcugggauuugaacucaggauguuuggaagagcagucagugcucuuaaccacugagccaucucuccagcuccucaaggagucuuaauuguugguaaagccaccaagacagaggguuugucucauagagcugucgccucagggauggaauugggggggaaagugugaugagacugaaaucuuaacugguuuguuuccucacagggcucugcacccaaaacuuccaccacgccaggaaggagcaguuccaagccagacucgcggagccugaggaaaacaccaggucuaaaagccaaagugggucccacugcugccugccugaggaggaagagugagaguagaacccuaggcuccgacagggccuuaucgccucagaggaucaggcgcguguccggcucugguaaggcaaaaguaacucaaguauucucauuauguagcacgggauggauguuuugcaaucagaaauuaggcuuggcagaaagcagaaaggccaucugguuuuagagccaaugcauuaugucgcuaaagcagcgagcuuauugugguccaacaggagagaagggccgucugaggagacagcacagccucuuuccuuugagcagugcaaagcgucucuggcgaguggcugaugugccucaacuuccaggcucucccaaagcgugcguauuauaacugugcaguuggcuaguguagcaaaccuugugaugaucuugauugucaguuugcaccugggaagaaggaaccucaauuaagcaauugcguucaucagugggcuugagggcaugucuagagcuuuuucuuggcugcuaauugaugugggagggaccaguacacugugggcagagccacacugaggcaggaggggccuagucugggaaagaaagguagcuaaacagcaaacugggagcagacuggaagccaguccucccucggucccucugccucacuucccgccuugaguuuuuuuguuuuuuguuuuguuuuuuuguuuuuaaagauuuauuuauuuuauguaugugaguacacuguugcugucuucagacacaccagaagagggcauuagaucccauuacagaugguugugagccaccaugugguuucugggaauugaacuuaggaccucuggaagagcagucagugcucuuaaccacucagucaucucuccaguccaagaggguuuuuuguuuuuuguuuugucuuuuucgagacaggguuucucuauguaacccuggcuguccuagaacucacucaguagaccaggcuggccuucaacucagaaauucgcugccucugccucccaagugcugcgauuaaaggcgugugccaccaugccuggcuccugccuuggguucuuaucuugacuuuccuccauuacagacugugauguggaaguuuacaaggaaauacaucuuuaccuccucaaguugcuuuuggucaugguguuuaucauagcuacaggaagcaagcaagaacacaagagcgguuuuauuuuuuaacugaguguggugggcaccuguauaaucuauuuggaaaguagaggcaggaggguugcaugguuaagccccaccuggaauggauauguguauguguguauguauauaucuauauauguacacauguauauguauauguguguacauguauaaauauaugucuauguguauguacauacauacauacauacauaugcaugcauguaagaugacucaggguguugguugccaagccugaugacccgaguuguguagaaagagagaacggacucccacaaguuaucuucuggcugucacacauggucucguucucuuacacacauauauuaaauaaauaaauuuaauaaaacuaagcuaagcacuuaacauacuguaaugguuuuuuaaagguucauaaugugcccccaucacauaggaagagauuuuuuucuuuugaauuguaaugaaagacaguuuagggggcuagaacagcaacugaaaaguuaaaacuuuccuaaugugaacuuucguuuaccuuggcugggauuucagaaguucuaguuuuaaagccgaaucaggcugaaauuugauagcagcaccaagaacggcuguuaagggccuuacucaguuuggcagaugugcacauugcuuuguguaaugagcuggaacagcaagugcaaaauucgccccuuucauagacugagacgaaaagccuguuuagucaccccagugaaccgagagagcucuccgcagggaacaccccuuauuucugcagguacagccuugagcaaauuaaagacauauuggauagaucacguguaaaaaaaauagugacuaguauugaauguuuaaaaaaugugccccuaacgacgauguuuuugcaugugagaugcuucacagagccuauagagccagccgaaucccggaggaccucuuuacugcacugcaauuagcauuuuuagguuuguuuugcaggguucuaucuaucucaaagcugcuagguccaggcaugugcuguuuagauucuugguuaauaucaggcucauaaggguggagaagcagaccccagaugacguggagagagaucgguagcuaaugcccauccccaggggaacuaaauggacagaaacucggggccccauuaaaugucaucauuugggaggaaaauggggaagcuaagaugugucugaaagcaguaguucuuguuuuccauauugccaccacugggcgcagaccaggaaggagaucugaguucuggucuuccuugcugcugccugguguggcucuuggaagucaccagggcuggagagcuccauuccugcuuugauguuuggagcaccugggccuuggugccacguggagcuguggucacuggcacccuggccugauugauguuagggguccuguguucugauuucagucuggcaccagcgagcugccagguucuggcaaauauuuccccuccguuggcauggacacuuaucaagaguaaggguuucagaaucuuggaauccaauaguuuuugcaggcuuguuuuacuagggaugaaauggaauucaccuaguuucuuugagaaauggcugcuccucgcaugauuaucugagcaauacgaugcuugcacucucucucucucucucucucucacacacacacacacacaaacacacacacacacacaaacacacacggcuuuagaaauugggucccugcccaagaucuauuuaagcagauggaacucuuuauggagacgaucaguccuuuuuaaaagucccuuuaccauguguuauaucuauaagagaaauguggaucuguuuaaaaaaaauuguuuuuauuuuuaugugggugcuggaaauugaauccaggucaccuuggacguauuuaaauuuucagucugauuuuauaaaacuaaaucaucuuuuacuuguuuuauuguuguugagacagaguuuuauucuguuucacuggcucaucuggaacuugcuguguagccuggcuguccuugaucuugcagcaauccuccugccucugccuucugagcgccuaggguacaggcaugugucaucaugccuauuuacacauaguuuucuacacaugacuaggagaaaaugugacugccaccauuauuaucuauuugaauuuaaguuuuacuucuguaugguuagaagacuucuguggacuggaggcuugugucaccccgaauuuaaaaguggaagcccuaacuuuggagcuagggccugugagaaggucucacaauuaagauaaagauaagacccuaggcuaaaccaacuuacaggaagaguaagaaugccagcgcuguaucucugcuuugugagaugcaggagcaacggggugucuugggaagagacucaggcuggcaagcaacuuagcugagaucuugaucuuggacaccucagugucuagaaauaagagaagauaaauuccugauguuugggcuguccagucugugguguuugugguggcuagcugagguaagacagaagacaauucagcugugcaguguuauguuuaaaaauuagcagcuucucuggagaaucuccaugaauugggagguauuuggagaggggggacaggaaaugugacaccgcugaguugaagaggggagagaaccucgggagucucugcuguacaaugaaguguuugugcgucugcaaccgaaaccaaauggaggccccugcccccccccccagucuugcuggcggaaagguaacuggcugcagucguccaaccaagguggggcuuucaaucaaucuuuuuagaaaaccaagcagagagacccggagucaaaauaacaguucuuuaaaaaagcuuuaagcugacuaucagacuacaguuacaauugggguaccuccauuucacguguugucaaauauggaaauuuauauaugaucacagaauauaaaguaagucacacccaaguacuuugcucuuucagaguguggguuuuguuguugauggcggugguaaggaucgaacuccggaacacuggcugggccuugagcaugcuaggcaagugcucuuccacuggacuagauccccggcucuguuuuguuuuuguuuuguuaaugaacucaauuaaauaugauuagauaaugaugggaauuuuccuagccaauuauuaccacgcugaugauaucagcuggcucaauuuaauguauguaugccaguuucucggcucuaacuuaaucaucugaccucuugaguuuauguaacacucacugugauuuucugaggcuuauuuccaucguaagaacuaggagcccaacaugggugaguucagugacauacauacacugagguuuugcugccgggaagagccgagguggauuugaagcaggccgugacgcuuuaagcucuuggccugaugcuaucacacagaagaagcgccaucggaccaucaguucugaacauagaaaaaaauuguuuuguccucagcuaaaugucugagggacuguaggcuucuuagguccugggcuuuaagccaucuucucaguuuucuaugacguaaauacuucuuucuauaggauuauugaaaacuaauggaacagaggaagugcucagccaggagguccauugugcuaugguccguccuggugucuacagagcgucacuagccacuccuuucaguugcacugauuugggcugcuaugguugugccucucuggguaguguaaaacuguccccucggcgacccgugugaaccacagggugaccaaggcaggauaggacacccucucuuccuuggaacauuuaucugcgcuagaaagucugaucaacccucuugcaccaaccaaaagcuacccaaagcgcugaguaagggcugcuugcgggggauggguuuugguuuuuacucuagagaaagagcguuugggagugaguugacccaccauauuuauuugacuuuuuguggguuaauaaaucccuuccuaguacauccagaacuaguaacgaccugucuguuguugugaguuuuucuuuucauucaguuguacagcuucuugguuuguauacacccccuuuuuucccuuacucagcauuugaaauaauuuaaaaucuauaaaaauuguauaguguuuccuacauuugagggaggugguaaaaauauacauuuccucuuuuauguccauuaguuauuaaaaacuagaaauuaucaguauguuaguaagucuuucagaguuaguaacagauauuccuggaucuguaacuaccuacaacacauguucgugugugucuggggacuucugcugcaguauuaacaggaacugaugggcuggggaggagcacaguuauaguguggcaggccguaucccaagcuuucuuguguguacagucucacagcuggugagggguaagugcagugguuaucccgucuccacaugaaguaucugaagguuugcaaacucaaguaacuaccgaaauuacacagcuaauaaugaguggagucuggcaauagggcuacacugaugaccuaaguuuuguuguugggccuuguccauacacuuguucaucaccuaacaugacugcauuaaagggaauauaaaucugacaauggccuagugacugcuuauucaugcugacuugugugcuugguauuagagauaaagaacuccaaaagaagaaaauauccccacagacagcuggaguugaacauucguagaaucuuggugcucagaggcuuaccagcagaagaauuauuaacucuaggccagccugggcuaucgugugagauccgugccaaacuccacuauccguccuuacaugaauacacaggaaagagacaggcaacuucugcccaagugauucuuauacucaaaugagggaaacuagaaaacaagugaaugaaauguucaguagacaauccagugagcgauaaguguaggagagagaauagcucagagcuagauuauacaucauugucaagaaagaucucacugggagaacugagcacaagcuggaaaugacaggaaagcacguuggugagagacuuccuaggccgacucaucaggcaguucagcaaagcuugugugugggucccagggaacugugcaguaacaaccguuuauaaagggggcuggagaagggacagaggcugaagcuggagcaaguagggcuugaaggcacagggaaagcauguaccuuccuccccaacauugucacugugaauuuagucuuucuugacaugucccaugguucucagcacuaauugggagaugauuguuuagagagggacaugugacgugucacucugcagccuauuagccaauaagaguaccuguuauguguuuggcaguccacuagauucugaggcuacaaauaugauuaagucagcauccuuuaagaauuggggauagcgacuggagagaggcuuguccaagccgagcauucucacugaugucccggccaccuagacuguguacuaugcuggguggugauuuucuuacauacccgucuccugccaaacucacauccauaggacagaguccagggaugaguuauuuuuauauuccccaguacucagcacgauguaccuguuauauaacaggcauuuaaaauguccuuuagcuggcuuugauggaggacuuagacaaagcacugaguagcuacaguacagagaggaaaccaacucagccuaagggaagacuggaggagaaugggggcauuaucagcugaucuuccaguguguccaugggagugugucaguagacaagguugcuggcaucagcagggccucugaaaggcugugguguaucuggcagguucuagacuagacuguguuuugagaucagugagaguugaccuucuguuucaagggagcuggaguuagaugaguucuagucaccuagaugcaaauccugagacucuuccaguguucggggaauaggaaauagaacauguauuuaaaauaucauggauguccugauuugccugcuuaguagagaauggucucaaggguaugccuacggauuuguauuugagauaguucuauguauccagggagaggucauaagucaaaauuaggaagagagcaagaaaagguuuucagaaaauacaugcugugaugguugguauaugcuuggccaaugauuggcacgauuagguggucugaaccugugagccagccccaaauauauguuguccuuuauaagacuugccuuggucauggugucuguucacagcaguaagacccuaacccaagacacaugccuccaaaguacuuccaaagguagaugcauguuuccgacuuaagaugauguuaagcaagccucuuccaaaagagccgggaggcuugagugagaccaguggucgggcauugaaaaagucacaguggggcggcuugcaaaggguuuaucuuugagguagaggggaugcgggaguguguggauauuagauuagugagacuagauagaggucagaagugagggagagagcuuugcucuacuuugcauuucacuuugggcagagaugauucaccccaagaguuugcagagauuuuaauugcgcauucauuuuucuuguaacccuaggaaaggaaaaacucaggacggugaucaauguccaagucuuaguaagcuaccuguucagaggaguucucuugugaacuugccuucuaaugagccuggaagcugucuucggugguugugguuuugaugcugggguuguccccaagaccugugugugcuaauugaaugguuguccuacugagcccugccccagucucuuccuccauuccuuuuuggauccucaguguaagugcuggaugcuaaacaaauucccugguaaccguagaaagaccccguccaucuuuuucuggaaagcuggggaaggaugcacucaugccccuccgagucuuuuuuuuuuuuuuaaauuacauucugaauuuugaauguucucucagguucccaggcccaugacuaaggaaguuauuuuugcuuaauccccacucugaaacagccgauccuugugaaagugcucucagagacagguaccgacagcacuaccaucaacaccacgcuucugugggauucaaggcaucgugagaaaguugccuuguagauguucuuguuucucugucaaauuaccccucuugggacugggaguguuuguguugugacucaccgguguugcuguggcuucgugaugucagcuuaccuuugaaucuaagcaagcuguggucguuacgccaaggguaguuucuuaugcccugccuacuaggagaacauuauuguggcuaaauccugaagucacauuuagcaguaaauaagcauagaguggagcagaaacccuguguucuggaaaguuaguuaguuaacaucugguuggacagcgacuggucauaugucauaauccaaaccuagaaaagugguggggugcacaccaugguuccuaauagccgagucagggaggcgagggguucuucucauuucauuuguucuucuaacagaaaagaagguaacuagcagcacuuguacaaauaacagcaugggaacugagacauuggcuugcacccuuacuuggcuuaaaggucaaccuuaauugauguuggugcuuucugaugcuuaaaacccccgguaggguagguguggugguuugugccuguaacugaagcucuugguagguagagacaaggagauugccccagauuggagcuacagagacaccaucucaaaaaccaagccuagcaaacaaacaaaagccagaaacaaaaaugaggccacacauagacagaagagauuguaaagguuagggacaagaucagggcagagagacuggaaacacagagggagguggauggucagugaguguucuaguguucuauggaacgguguucuggcugccaaccagaaaagucaggaaacacagaagcuaggucuguaauauagaacauaggggaaguguucaagcaaagcuagccgggaugguuugacuuccuuaaugcuuugcauuuuaauugguugauuuggguagcuuuucaguuuucuacucuucccauuuuaguaguuauuuuaaagguggguggcauuuugaguggaaagucggggcaggggacucuuucagcucacuaccacucauaauaacaaccucugguguccaaauauauggcuaguacuccuaugcauuguauagagcuguuuacaggcauauuauauaccaccuacuuauagaaauccauugugaaggaucagcagucaccuaguuacuggauggcacuuuuuguuaacaagguaccugaugaaccugcuguuucaagauugauuuacuuacauauuuuauauaugugaauacuuaucugcaugcacacugcaucccauuauagcuggcugugagccaccaugcgcaccauguggaugcugggaauugaacgcaagcccucugggagagcagccagugcucuuaacugagacccauuucuccagccccauguuuacaauuucuaaauuuuauuagugccacgguuuucagugacuacauuuucugcauguacuguuuauucauagugugguucuaguauauguagcaugguauaagagaauaccacaggauguguaaucuguaaacaauagaaauuaauuuggcauguagucugaaggauggggaguccaagaauaugguccugguguuauccccugcaaaagacacagagcaagggaguaugggagaauaaacaugccagaggggaucaaacucgccugcagaaagagccugcuguccagucaccacgcacuagcaggacagccuuauucuacuaugaagucaaauuucaaccuguggggcgugaccccuuugggaguuguauaucagauauccugcauuacgauucauauuagauauucacauuaccauuccucacaguagcaaaauuacaguuaugaaguagugaugagauaauuuuauggcuggucaccacaacaugaggagcugaauuaaagggucacagcauugggaagacugagagccacugcauuucugagaauucucagaauucucccagcccaucuccucaugaggcugcauuggcuuguuuuguuuuuuucaacacauauucugggagacauguucaauccauaacagcugucuuccaugguuuuggccauuuccagagguuuccaggucuccaccacucugcuccauuaaacagcccuccacagaagaacuucgugcaggcauaccuauucuggucaggcauuucugaauacauuccucuggguggacccaaggguguggacauuguuaacgcuuuggguacacuuuauugaguugccauucagaaaaagcaugcaagcccaugcagcaccucugaugacagaagacuuuuuuccaaagcucuugccaguauuuuguuguuucugaaguucuuuccagagagucaccuuuaggaagggugugaaaugguauuuuaauuggccuauaacuugguacuuaaauauuuauugaguacauguagauucacuuaugugcuagagaacagugaauacaagaucaaaacaggcccugaauauugucaugcuguguaacauggguuauauaugaaugaaguguaaaguauuuuggguacugauaaucuaagaagauugaaaaacugcuaaaagagagaaguggagauaugaggugaauguguguguaagggggggggaggcaugaaauuuuaguguaguagggagggguugugaguucuggccugaaggagcaagugcucugaauagcagauggaaacagagugaacagcaggaggcacuugggaucugugcucugggaauggagggcacaaguagccaccagaaaccgagaaggcagaggcaugcagagcuggguuauauguagucuuaaaguucauaaggacguugucuuugagccugagugacuuaagcauuuguaggaucacuguguugagaguagacugaaugcaagugagguugggaacuggagaggaagugguacugaugcaguuauagcaaaagguauucuuuuagcaccaggacuguggcggguucuggcuguagaccgauacauggauguuagaaggaaagcugauggguugaaugagggaugaggaacagagggguggugccuuuucacugagcuagaaagauugaagggguggaggucaggagcuguuauagagauacuaaguugaguagauauaagacagauauggaguagugccuguaaguguguagucuggaggagcucggucgaggguuacaaauuucagauucagcagccuguagguacugaggacaccaaggcacacacagcacguggaaauguggccaagggcaccugucuggaacuuccaagcuuaaaauagaggcugaggagaaaucuuaaagaagggucaacgagggauagccagagauagaggagggaaggcagucaggagagacaacagaagagucaguuaccuacaucaaccacuacagacagguuaguagggccaguaagagcaguuugaagcagguaguagcaauugccuuaacacacaaggcuauacaucuaauuuaaaggaggccuggacaaaggccauucuauguuuggugauuaaauaaugucaccuccugcuucuugucuguccacccuuccugcucagccuauugucuuaaugacaaaaaucaguuaaaacauggucgccaaaaguuccacccaccacaaacucuugcuacuguucucaaaggcuggaagccaagggcaguguccuaggguaguggcucugccuucacaugccugccuggccguguugcuuggggaggaaaucuaguugugcacagcauuauucuucucagaucuucuuggccccaagcagagaugauguucacuccuuauagcagaagaggucaggaaacaaggauucagcuucaauuuuucuucucuaugggaguccuggggauagagaguaaaacuagcagcuggguagucaaaaaagguauuagagacaggagcacagccuuacauguuguacugacuuugcuuacccguuagggcuuuuguugacuuguguuuuggaguuggcccugccauuugucccauugcuacuaccugacuguuaauuuuguagcuagugauuuuuuuuuuuuuuacgaugucaggaguucccuuuuacguuuccaauuucuguauauaauaacgagaccaccuuaaacuggaaagugacauauacucaguuaauaauuuuaugguuucauuucaaaugucuugcuuuuuuauacaauguauguuggcgaccagucagagaaaggagcuaguauucacaugccacucuuuaccagauacauuucuaagacauuuguuuggcgagugagaggcccugugaaaugacgcagcuauaaucaugcucagacacaaggaggcaagaagcccagagugguuaaguaaccugcccccagccaugucugguggagauggacguaaagagagcgguuggauucuagauugugucuuuuaaccaugcgccaugguacuguucaaauuuuaauuuguauaaagaucucaauacaaauggguacauuuuuuuuuggauugaaaucaccucccuugcccuacccugaauuuucuuucagauauucauauauaaauauauuaaucuguauagcugugugucaauuacaauauagaaagcuuugguuuuuaaugaugaaaaugcucugcauagauagauccuguaguguugaguacauucccauuagagcaguguggagccgccauuccuguuucucaaacauuugccugcucugauuaguccauuaaaaaucuaaaccuuacuuccuaagucucccuuucucccacccuuuggcaauuggccugauucuuucugucccuaugacuuuacauguuccacgaagcucaccgaaggcuaaucaugcgagaauuuuccuuugugauuaacuuaaugaggcuuagcaucaugucgucaaccuaauucacauuguguccuugucaacauuuccuugcuuucuaaggcugaauaauaaucccuccuaugucugucuacaccagaugaacacaucugcccaugaauacuuugguggcuuccgcauuuggguuaccaugacuauuccugcugcuaacauggguguuacauaugguaaauccccggcuuucaccucuucuggguucucaucuagauaugagguugcaggaugguaugguaaauagauuuaauguuuuugaggaacucuucaugcuauggugcacaguggcuaccaugguguuacauaugguaaauccccggcuuucaccucuucuggguucucaucuagauaugagguugcaggaugguaugguaaauagauuuaauguuuuuugaggaacucuucaugcuaugcugugcaguggcuacucccugguuuguauucacaaagguaauagcucuacaugcucaccaguguuugauguuuuauccuggucauccuagugggugugaggcuguuucucaguguuugcauuugcauuucuccagugcauaaggaugcugaguggcuugcaucuuggugcaugccuauugaccacccguguaccuucuguggagaugucucuaaguccuuugccuaucuuuaaauuuaauugcuuggaugauuugcgguugagucauggucuuuucucucucucucucucucucucucucucucuucuagaauuuuaaagcuauuuggaccuuaauuauuaaaauuuaaaaaauuuuuucuuagcaccauuuuaaaaauagaucacuuuaaaauagcauuagaguauaauauuaauuuuggggaaaguuagccuguauucacauucaaaucuaucuugggugaauuuggaaagaacaggguauauguauauauuuguccauguguauaacuuuuguugcuaaaagaccuuuuuuuguuuuguuuggggggguuggguuuuuuuuuuguuuguuuguuuuuuuguuuuuucgagacaggguuucucuguauagccuuggcuguccuggaacucacucuguagaccaggcuggccucgaacucagaaauucaccugccucugccucccaaguacugggauuaaaggugugcaccaccaccgcccggcucuaaaagaccauuuaaaaagguuuuuuccaacaaacacaaaaacuguucuuuaguuuauaaguuuauuuauaaguagccuauuguuuuuauuugaagaacauuuaauauuacaguacucuccaaugaaacuaauuuauuagauguacauugcuaaugaaagcauuuggcccauuagaguuaauugcaauugaauauacagcugucauuuugagaauaguacaauuuguuacugcuuuggguuuuacuuuaauuuucuaauuccuaguuacuguagauaauuucuauaaaggucuuuuuauguaguugcauguaaagagcugacauuauaaccauagcuauaacaggguuaucuuuuguuugaaccccacauucauuuagcacuuuaucuuccugagugucccugcugauugcccaccuuauuaauaauuaaauguuaccaagugaccucagucaccuccucauggucuagagaaaauucccauacccuuugcucaggcaaguaugccugccuccuaaucucuacuccauuucucuacucuucccuuuggacaaggccugucuucuaccaugugaucaaaauucuaauucaaauacugagagccauccaugccucucuccaucucuccacuauauucacuaccaaaguucagguuuaaaguucccaucuggcguuuaguggcaucucuuucccaguugugaaauaaccacaucuccaacauuguugcucuuuucuuuacccugccaucugcggucccacuaagaauggacccuccagagcaccaggcgcugugucaugggccacagugacuuuccuaguuacacuuuucuuugcaaacuuuugucagauguuucagauacacaggccugugcuuuugugaucgcuuuuuuuuuuuugcaaguuaccuuccuggcucagcaaguaaacacuuguauaauacacacucccaugugauuucauagcccagauauuuuuaaaagaguggucuguguuguccauuuuagguaacauuguaguagauucucauucuuucuaccuuucuuucuucuucccccaaucucguucucuccugccuccccugaucucucucucucucucucucucucauauaacugaaucucauuuaugcaagccauacauuuuaucaaaugugaacugugauaugcuuuaugaugauguugaaaagccucucacagcuuuguuaagucccuguucaugucugcuugauaguucagagaugggaaaucacuuuggcugguagauguuuuguggcuccgggaauugcugucauuccuuugaaggugcuucucucuugcaguguggacucacuuaccuuucccaggccuuuccuuagaguaggcugagucagcacugggagacuggcaaugcaccgucaaaggcccuggagcuuucucuuggagaauaaaguauuucauagaaggggaagacaaaggagggccauuggggagcucauucuuuggcuuucauuuccagcccuaggaaacauaccucuuaggaaaucaugacuuuccacuaguaaaauggcugucuucauaauaaccagauacaagcuaugaauguaggcauugacuuaguguccuucuugagugaaauaaaaggguggaugaugagcuacugcuugcagauggacucacacagcuacuggaaucuaccuugucuguccaguuucuccuuucuugguugccggauccacuuuguacugggagucgugcguuugaaugugguccccauugacuucugcauuuaugacuuuucauuguuaacugugcucgccaucuagagaaaauccauaccaauaaauguuuaaaugcuaaugaugagggaauggagaucuucucacccacgccuuuucuaguacacucaaucuuggcagaccccacgauacucccauuauacugcaguauguuuuucugcaacuguuuuauuauaaauuuaaacuuccugugugauauuuuucuucuuucgcgcucuugaacuugaacuaauauuguguaaacgguuauaauuacaaaagugaauguacauauguaucguaauagccaucaaaauuccaauguccuauuucacaggcuaagaauuaaauagccauaauucauuuggaacuuaaaaaagaccacgaauaaccaaagcaacccaaaggagccaaggaacauggcuggaagugucaugaucuuaaccucaaauuauaaagcggagcuagaaugacaaagacagcucaguaugagaauaugcccuuaaacuaacggaauaggaccgaggaucuguaaauaagcagggaggguggagccuaauuuuuguugaaggaaucacaaaaacacugcaguggaaaaaaagccuuuucaacaaaugauguugacaaaucuuaagaugcccaucugccgaagagugacguuaggucuguacaaaaaucaacccaaaguagaucaaaagcucuuaauucauaaugugaaguugucagagaaaagacauaggggugagccacccauuucugaacagagcgcgguaacacaggaaccagggccaagaaucaacaaaugggauuucuugagauuaaaacguuuaugcacagugaaagaagccaucgacugugggucaaacagcucacagaaugggaggauaucuuuaccaccuacacucuagacaggaggcuuaucucuaaugaacugcaaaaauuaaacaccggggaaauaauacugcuaauuugacaggaugaacacuucuuagaagacacacagaagacuaauuauuuaaguguucaauaucccuaaucaucagaagaauaucaauuaagacuacucugagauacagucuuacuucagucagaauggcuggugugaagaaaccuguuaaguguugguggggauuuggagaaauucccacuuauuguaugugggaccgcaaaucaauacauuauuuggaaaucaguuuggaaguuuguaaaaauaauaauagaacugcccugugucccagcuauuccacuccugggcacauacuuggagaauuccacacucuacuagagagaccauguuuuauuaccgcgcuauucacaacagcgaggaaggagaaucaaccuagauaugucuaucaacagacagauaaggaaagugugguacuauauauuauugaauauuauucagcuguaaagaaaagugaaaucuugaaacucccagaaaaauggauggagucacaaaauauacugaggucacccaaacucagaaaagaaucacacgaacuuccucauaugcaaaucccagccuacagugcauaugaaaauugugugugugugugugaagcaggaggauugcuugagcccaggaagcugggcaacagagcaagacucugcuuuucaaaguuaagcuuuuggugaaauagguggaagggagaggguggguggguugggagaucaagaguucccuuggaaccuuccuaaggaaugcgggcuagggcagguaaggggcuggugaccgaguaugggcgcgugugcuucugggcaggcugugcguuagugagcaugguguaggucucuggaggcacacuugaaagaucuggaagucuaugguguuuccagaggcaguaccaggaagcacaccuuuccaaggaauccuguaucuccuaagcuugcuagguuuugacuucauuguagcugugacccagaaaauuugauccccggaccuuugauuuuggaguugacuccaucuggaugguuuuuuuuuuuuuuuuuuuuuccgacaggguagcaguuugauaaauuuguauucuaaagaucugcuuuuccauuccaccuaaagccagugaaaaggguuggcacgagaagugaaagcggaauggguguuugaacauguaacacuugcugugccuguuaguaaggacuuguauuuaauuaauagacuuaaagagucaaauugccuuguaaaaugggcgauuaaaugucuugguauagauggagagagagaguguuuuaacaaaaugagucauuuacucauggcaugggaaggacacugauuucagcagacaccuguugcagcuccuugcuuuguaaaguccaaggaacagaguuggauugggaaugccucugcucucggagucuccacccagaucaaucaagcucaggaagccaguaggagguaugagcaaaagccagaccagcaagggggaagccugaccuggcagggguggcuugagaagaagccagaauucugaacagcuuagcuuagauuuaauggauuuuuuuuuuucaagguaccgggccuugaacccagggccucgugcaugcuagguaaguguucugucaugugcuggggacaaaccagugaacguaacauuuugccaccgucaccuuauuugucugccauugguaaaaugugacagcaucauuuuugucaaaggucuuuccaacccuugaugcacucuagggcagugaugcuaccagcauagcucgcauagggccacucggugccaggauauccggagaugauacaggcauggucccagugauuugaagauugccuaaugaaagggaagcgagaggaagccagagcacccacguuguugaaacacaaugaggaauucagugugaguggaucuggucuucagaaagaggauggggcggagcuuguggaauugagguucagucuccacuaaguccuugaguagagcauaaagcacaucaaauagacugcucaagaggugagcgaguuugaagaguucugaccaaaacaauuguuuggcaaguauguaugccuuuguuuguuuguuuguuuccagcaacgcaguuuuagaaauuugagugaacagcauuccucacaucaaguuuggcaaaucaacuggaaagaugaaacaggaacgggguggggaaaaaaaugagcauagcgccaccugcuguucagcuccgagcauuuuuuuuauuuagugaaagcuuucucccaaccgugauuuuuuugcuuugagugcuuuuaaauuuucgucuauuucuuuuuaaauauggccaccucaugugcuaacagagcagucugcuuauuuuaguguuaaagggaaagguaucacaucugaucguuucugcuuugaucacgguuuuaccaaaggcuucuuucuuaauguuuuuuuucuuuucccucauccuucuugcacaucagagaugugugaguuaauuacuugaggccacacuucucauagccuaauugcuucaucauuuccucucuucugcuucugaauuauucaaaagaaguaagugugugugcggcuuuugugucucucucaucugaagcaucauagcguugaacauuaauuuugcauucugacaacuccauggucgguagagaaguuugaauguaccagcuuaaaguacaaguuuucacgauagauagaaaccuuuuuuuuuuuuuuuuuuaaucccaaggaaagccuccgugcuugaaaacugcacucucuucuugggugaauuugccuagaccacuuccuauauccgaagcauccuugauaugcagggcaggaagcacccggucaguggccagcacccacagcgaccugagcgccuacagcagugacuguaagucagacugaugucaccuuuugugggugguugagacaguagacauaggcaaagccaaugguccacaaauaauuaauuuugucucuguaucuuagugggaauuuuacauauuguuucuuuguaauuacucagaauguuugacauggaaacaaguuuuuaggaauagauuucuuugaacgaaccuccagggaacccugaaaugguuacguauuacuggcaggugcuauauaaaggaacuuaaaguacauuauuccagcugacauguuugcagggcuguuuggaaaagaauaguagcuggggcucuuccagcuugagauccagaaaaccaucacugguuuaguuugguuugguuuucgaaagagugucuuguggaagugcuuuguaaacuucugcuuuagaugccagccacagggugguacaaauuauacagcuuuaagcuuaaucauaaauaaguuaaacucaggggaauacucugaaagguuuugugcauuccauuuucuucaugccgagugagcaaagaagcuaagcucuuuuuuccccccaaaaagacuucucccccuuuauucaaaagaugcauucagaagagagcuuuuuguuuuguuccccccuuucuucucaaauuuccucacgaaauaauccaugaaugaguuaagacaaacaacuuuggagggcccacugugccuaggaucauaauagguacagggagggauauaggugacagagaaauagccuuaugaauaauaaaaagcagauuaggagaaagagacagauuauauacauuugugaggaagaguuggagaugugagcucuuugcuuuaacgacaaaugcaugucauuuguguggggggugggguggggugguguggggggccagagucaucaaacucuuuagguguagaccagcaacagagcuaccauacacguacacgcuccgcuacuccacugcuuccaccccaauaccuuggucuuuaccuuggacuuuuaggagacuuaacugaggcucagagacuauuaccagaucaaagucacacagcaaguaugugacaggauggauuauagacaauaggcauugaguuaauggcaaaggacccauuucagacaggucacugaaugcagaggcuggucucauaggcacauaguauuaguauguuaauuaaaauuaaagaggguuauuauuuuuguauguauucauuguuuaaaauuuuaaaggggugggggaaaaccccaaaggguuuaugcuaacagguaauuaauucucugugaaccugaaaauaugacuagcauuuguuauuauugugaauucgucucccaucuagacuucuuuguccuacugugcaaauuaaaagaacaaaaacaaaaacagaacaaaacaaaacaaaccacccugauagaaucaccagaaaacccugaaagccauaaugauggaguuugugacacucggagcagacacauuccauaauaucacacccuggguuuucuaucgaacagccauguugaacuggccacugccccaguagccugucugacccugccaaggagguuucgaaaugcuuuuguccuuucuuuuugucuguuaacaaaaggguuuccccguguacccgcagagccugucuaguggccaugcgucccccuuacagauuaagcgugcacgucugccagucuuucuuagucugucgugcagcugguuuaaucuguuccguguagugccuggcggcuuacagcucucccccuccccauucuaauugacugggagcaagcaugagggaugcaugaacauggcugcagcuuuuccugccugagcuugcuuuguuccuuuuuaaaugacuauaccaggaggauuucgcaguuguacagaaacugauauuucuucaacgaucuuuaucaauucuacacucacacccccggccggcucagaaaggcaguaugaugcuaccuuacuggcacugcuugucgugggauccuacagccuuuguauaauuccuuuguuagccacgcuuacuaggaaaaaaaguaggucgacgguuucucaucugauucuuugcuuuguaagcaugcuuaaauuuuuauuaaauaaauugauuuuuuaggcccgcuugguuauuagcuuuguuguugcuugcaauuuauguugacugugguguuucgugauuguauuuauauauauuuaagaugugaauggaucuguugggaacaaauuuuauuguguguuuucugggguugggugcuuaaaccaauuauaauucagcuuaucaauguucuugguaugauguuauccuauuaccaaagaccauuugaugauuuaauuucugauuaaaaggcuguuugaugauuuaauuucugacuaaauacuaaguuuugagugugugacuggcagauguagaaaaauauuuccuuaggauuuaaaugaaagggucagauuuuuuuuuuguugucuucaguuauaauuaauauacaauucacauaauaguguuaaauguguaugcguuuuuuuuuaaacugccuuaagauauaaaaaaaaucauuuugaaccaaaaucaucuugcugcuguuauggaggggucacuuaaucuuuagcuggcauaucaugacugacagcuccaacacuggagccucugugaggggccacacuugccuccuuugcuuccuuuugcuuugugauguuguauuguuaguggugucuguuaagaaauccacugcacagugcuguugggaaauuggcaccugguccuugguacuuggggauccuuagaaacaauguuuucgaguuauaaguugguugaaaggaggcguauaaggcaauuuuucuuauaucugaggguuucucagguuuuauuuuuuuuuuaaugaguacauaggaaaaauuaguaugaagauauccguguaaagauugugcagugguuuuucuauaccaaaugagagagaucauugugcaauuuggaagcaggucuugagaaaguaguuuugccacauuagcaggacuauggagaccagagauuuccuuccccuuucccuuuggccacaaaagcauguuuauuuuugaggacagacagaugguguggggcaauggcagagaugccaaccaaagcuguuugcuugcacuccauccgcaauaggagauccaaaagauuaauaaagaaaugggccauccucuccugcacuuggguggcagccuggcugacaggaagugacaggaaaggguacuacucaccuggggcuuguucugguuucuauuaauccacggcaaaucuuaaaccugaugaacgggaagggagaccuggaccacggucagcauccuuccagccguaugcaccugacuccuuuucuucaccgcaguaccauggugccgcccugucucuuggaaggaaagcgcuucgguuugcccaacuaagugggcagaaaggaugagucuuccugacacucaguuuuguuucucuuguggcaaaagugguuagugaguauggucauaucugucaacacugggcagucgauaagaaccaauugacucuuuuggcugccuccagguucagagaaaaaggguauuugauuagugaugucugucacaggugaauagagagaggugggcagcggauagugcugucuccaucuucugaggcauguuagagugcauaccgucugaagggauuacuucaugaggaaauauucagauaacucuuagucuugccuguucucuuuuaguaucucuauguggggcauaugagacauucuugugauuuuuuuugcuuuugaacuuuagaugucagugauuugucuuaaagccagguaggcagacgaucggcgcagagcagagcguuaagcugauguacaaagaguuucagaaaucggaguuuuuauuucugugcagauacagggaguuuaauaaaaacaaaaacucauuuaacuagaugccagaauguauuaagacaugcuagcucacaagccaacguugagaccgaagagagaaacucuuuagagugggcaaauuccuucuucugccuagaauuuucugaaacguucaacgcauucucucuccacguccugucuucuccgcuucuuauuccacuugcaacauucccuggucuggggauaugaaaauagggauuuuagaaaaacccauuguagcauaaccaagagaccauuguaauaggcagcucugagugaggcaacaguuggaaaucgacaggauucugggccaaccacaaugcuaggagcugaguaggaaggaaggagaaacgcuucgagggccuccugccucauuguaguagucaguuuucuucuucuucuuuuuuuauuagauauuuucuuuauuuacauuucaaaugcuaucacaaaaguucccuauacucucccccugcccugcuccccuacccacucacucccacuucuuggcccuggcguagucagucuucaaguuggaacuuagugaaaagcagugugccagccaagaggaaugugcuuagaaaacggagagaaugcuuauguguuaggucauaaaaguguguucagcuuauuacagcugguaaaguugggugaucauacaauggauaaucauggaguaugaauauuuaacacauauuucauauaaauauguaauuaugucuaagaauguaaauauauacauauauauguguguauacacacacauacauauguaucugagcccagugucuuuuauccuugagauauggauauugacucugguguguucagaaguugauggaaucuggugcuagaucuguugccauagugagcccucgagagaaccacucagguagauuucuuccaagucagugucuccugugguaugaggccaguagcugggggccuccuucgugucagugaggaauucgaucacuaaguucuuugugagcgagaacccugugugaguaagguucagaaagugaagcaugcauccagacuucggggcaaucuuauguccuguucauaaacugagcuggguuuaauuuuucaaaguuagaacaauugacuuaccucgcugcugaguauaaccaaaguugcucuaagaagagcaagucuaaaauccaacuguaauaacaaaaggaacucccuuggauuggauucaagucuguuaagcaccuacugcaauccaaugcccacaucucaugaguaucuuaaaauacacacucugaaagguugacaccguugucccauguguccuuuagaaugugaugucgaauauuagaccaucaugucagcuaacgugcugccaaguuuggaaagcccuguucccuuaguucuaagcaaggugagaaucagaaaugaggacaggaacuggguagaagcuugcuagcaggaggguggauuuguguugaucuaauauuaggaaaauuguccagguauaaggggaguuaacagauggcucagugcacagaugcugggugagggccaggaaagccugugugugugugugugugugugugugugugugugugugugugugugugcaguguugguggggaugaggucauuuagccuagugaaaaacaucuauguucacguugauaauuugugaacaagaggcauguaugaaguugguaauuuauacucuugcuucacagugcauagacuaaaaucaaagcaauacagggaugcuaacauggcuccugaaccagagugacacauaauucauucauguggggcauucuguaccagaaagaaauuaugauuuauuuauuauaugguagauuaaaaguggauaccuagaauuauguguuggcaggaucuuagagaaaauaggucagguucuuuagugucuuuaggaaacuuuguguuuucuuauaggugguuuucauugcuuaggugagacucuuucuguguuuuuucaguuugagguugaguaccuguauaacacaguggaugcugacagucuagcucugaaauaccagaucuuacucuugaagccacugaggauuuucucugauuauucuucucuucucuucucuucucuucucuucucuucucuucucuucucuucucuucucuucucuucucuucucuucucuucucuucucuucucuucucuucucuucucuucucuucucuucauuagcauuggcugcuuacagucuguauugucuuccgugagagaaaugcuuaccuguguauguacuaggaauguuuauuaggcagcauggguggccauuuaucuuccaccucucugggauaaaaugccaagcuggaaaugugcauaaauugcccaggaacaaaauguauuauuuuguuuguguuugcuuuugcauucugggaacauuuauuuuucauacuugaggccaguaacugccucugcauucuuggcacuugguaauuguuaucaaauuguagucucuuuggaacaaauauuaggggcugcuauuguauuucuguacuaaauaagauguucuuuuccauuuuguuauagguggucaugcugccaucaacaaauaugaagagaaaccucccaaacaagcauuucagaaugggucaggacccuuguaucugaagccuuugguacccagagcucacucgcacuugcucaaaacuucuccaaaagguauugucuuuguugugauuagaaggaauacuuuuaaacucauuggcuuucaggagguuaaauuuugacaacuaggcuuaugguacauuuaacaauuauauauuuaaacacugggugugaguaagaaaauaaaauaaauguuaacaaugagauguucucauuccccaagaauuccaaauucuauagacagauggagcccaauaguaaaaaucaacauguagagaggcuagagaggugacucagcgguuaagaacacugacuggucucgcaaaggacccagguucaauuuugagcacccauauaguggcuaacaaccaccuguaauuccaguucuggggagucugaugcucuuucuguugggcugcacagguacccccccacccccccacacacacacgcaaaacacccaucucauaaaauaagaaauaaaucucagaaaauagcugguagagcagagauguccggagacacuaacaagaagaacugguguucagguugcugggauuugaacucggaaccucugggagagcaaucagugcucuuaacccccgagccgauucuccagcccacuuuuuucuuucuacuggguuaaaggagaaaagcaaaaauacaggguggaucgaauccuguugggggaaaauuauuuacugugccauuagggucuuauuugucuuacacacagcucugaagcaucagauuauccccugcuaagauggcgguaauaucugaaacugagguuuuuaaucaugauuuuuaaaaccccauacuacccccacaguaacuaaaaauaaacccccguucauggagcuuugaucuugaggugauuuucagagaacuagagacccccaccaaugacugcaaaacaggacaugccgaacuccugaaagcccuaagguugacauaugcaucuuguggaggucucuuuaugauggcuacauacuuguaaagggagaugaucuucuuccuaaaguccugcagauggucucuggcuguuccaaccagccgccuucuucuucuccuucuucuucucccucuucuucuucuucuucuuuuuuuuuuuaauauuuuacuuauuuauuuauuauauguaaguacacugucuucagacacuccagaagagggcaucagauuucguuacggaugguugugagccaccaugugguugcugggauuugaacucaggaccuuugaaagagcagucggcgcucuuaaccacugagccaccucaccaguccuccaaccagucuucuacagaugguuagucacuugaugaguauuggaugucgagcacgggugcuuauagcucuuccaaugucuaccuguaugguuccuggcugcauuuuauauugcaucagcuuggagaaacaucucuaguguauucuccuucacagccuugggagggcacacaccagcaucccucuuucacaaaguguagccuguuuccugugugcagaagaagagugaaagcacaagcuaagagaugggccuccuuuuggcuggaguauaguucaaugguggaguuuucuccccaaucugugggcccuggauucagacacuagaauaaacaauaaauaaauuaauuaaaauuuaaaaugagcuuuaauugcccucgacuacaaaauauaccacgcuuugucuuuuuaaaauugaugcuguguuuugaugauuaauucuuaccagucuuacuacgaauuagauacuauauugucuauauuugaaaaaguguacuugaucaaguuguuuauauguuggaauuuucucaguggauagcuguaaccuaaaauuuagagguuaaaggagggcuuuuagaaaaugaaaucacugcuauuuacaagauaacuagagauuugccuagcauuuccaauaaaguguguguuuauauuucugucccauucuagguccuucaaggaagagucuguuuacagcuuuuaauucagguaaguggccacuuuaugaauauauuaaaauauuuuuauuugaaaaguaaugauuaaacauacugaaauuuauuuguaauuacuuuugcugguauaguucuaagucgaaauucaggauuuaagguguaacuagcugcuaugacaugggcauuugggcagcaugauuuguugagccaucuaacacagaggaugacaucuuguuauacagaucaaauuaacuuaaacugauuuuuaaaauaugguucaugugaaauaaaacuggauacuucuccaaauguguuauuuuaaaucagaucaucuuuaauuguaaaauggucuuaagguauaacuuuuaacuucuuguacuaacucaacaguuaguucuauguuucugacuucccccauacacauucuuggucggacauuucuaagacagccuauaacuuaaagccauucaacuacacugucuaauacuuccuuugggggaucuaaagaucuuguaaaauguauucauugacguuucucuguaugacacgcaggacuguaugcagccagccaugcacugccuacagguucucauuuuuuauuacagugcuaguauaagucacauggcucccauugcacaucacagcagaaagccagaaaaaagaaaggccacguuacagcguguaaagucucuguuauacaggaucucacauugucagcacagaauucaaccaugagcuguggguuccuacccggcuguacgcaugucaguuaguuucacaacucaaggugggccuggaauuaguuugagccuacugaggaaaacuuccccuguguggcuuuugaagcaacccugcuuggaacuauugacauuccuuuuuguuacaugccguggagugaucagcuuuaaugggucacccaguguaagugugauagcauugagccucuuggcuauucgaguugguucucugucacauucacagugauugcauuaugaguuguuuugcaaucauuucugucaacguuugcgaaguuuucuugugacggcuacuucagaguggagcgcacaugcguuguauaguugcuuggauaaucauauuauuuucaaaaagcuucauacuaguuucugauaugauccacaauauagaagcacuggccauaugcuggccaaucgcugauugauugauugauugauugauugauugauugauuuuuaagauauuuuauguauuuuauuuaauguuguaaagacuauuuuuuuuaauguguguuuugccugaaugucugccaguguaccacaugcauucaguacccuggaaggccaaagaacagugucacauccccuggaucugaaguuaguugugagcucccauguagguucugggaacugaacccuguuccccaguaaugcguuuaaucugugagccaucucuccagccccugauugagggguuuuuuuuuuuuuucgggagugggugaggggggaguguaugaaauaauauuugaaaauuuccaucauuauuuuaguuuaacaguuauuguaaagaaauucuguuaccuccgaagacaaugaagaagcugugaccuugugcggcucggacguugguguaaaucuugauucuccuccucucuauuuccguccugaccucuggcuacuugcuaagccucuccagggcuugaguuucucgucuggcugcacgggaauguucaggagauaaaucccagugugggaauggguuugaccguguagacuauuuucaucccuagcucucacaugguagcugccccugcugcuacugcuaucgaggcuaacaguacuucuuguugaucgcuuuucauggcuuuacauugaaggcgccuccccaaucccacccugauguguucuaggaaacccucaaagcaaguggggaaacccacugaggcuaugaaccaccuuccagaggucuagccggugugguuuauuuaaaggguauuacacuauggaauucuaggcaacacuggcucuaaauaaaacgugccugcuguuuaugaggaaguugucauacccacagcauuuaccguggcuccgacacucauaguugcucuuggggauaucucaggcaucccaaguuguguuuacccaguccguggacuccuuuauagaucaucccugccaggugccauggugucugcccugggagcaggaacacaccugcuccaucugugccauuucauaaacauggccuggggucguguggcuuucuacaucuccuuucuccaaugucgggaggugguugagagcugcagaccuacucuggggaggagaugagaugccgccacacugugcaccugcugucuuuccuucuuaugcauuggugaucucaacuuugcucucguguugaaagggccgauaccaucuggauacauggaaaauuugguacugagcguuacgaagaauggaucacuuggugaaucccacugcaacaguggcuaccuuuuuggcugagaacuagaucucuucacccagggcacaugaauguguucuacauagaaaaguuguaaguguagaaaugaaaaaaaagcaccaugaauauagaccugaguauagaaggccuuccaguaacaugcauauaacaauagagauuaauaauugugacagcacaugguuugagcuuccuuuuguuaaaucaugacaaacaguaguaagaacaaagccagacaauguuacuacauuugcucuguguagcacucucgaaaacuagcaagacagaaccagccucagaguagaugcuaaaagggccuauugucuugagucaccucugucaacauccuuauugcauuuuuuuuaacugagaaagagaagucacuaugugaaauucauggggaaccaaauaagaguccaagguagccaaaaacaaucuugugggcggaaaaacaaaggcgaugguaccauaauucuugcuuucaagucuguaauuaaaacagucugaaauggguaugaagguagauacauagaccagugcaaugaaugggacagcccagaaacaaaccuguggacuuacaguccgcugaaccuggcaagacugacgaaaauaccaagcagaaccguccucucuccaagagauagcgugaggagaauuagaugucugugggugcagcgaacuccagccuucaucucaccucauacacaguaaacaacucaaaaugaauuaaaauaagacucgaagcccaaaaaccucaggaggagaggcagaaggggagcguuucauggcuuugucguuguccgugauuucuuagauugauacagaagccuguggcaagcaaaauuggacaugugggacuccccaacucuucugcuuagccagggugaccgucgguagcaugguagguggccuacgagaugaagggacugucuagaagccauaucccaaugagggcugacuuaccaaagaggagucaggguguggaaggagcuuugaucugccagguaugcagcauucucaccauaacugauguaagaauagcuuacauaucuguagguaaagaaaaugugauguaucuaugcaauggaauauuagucacaguacgauacaaacaaaguaaauggggccaaggagauggcugggugguaaagguacuugcugugaaaccauaggacaagguacuucggguuaucuguaaucugcuguugggggauggaaauugggaggggagacgcagagucucugcagacucggggccaagguacccugguggacgcagccaaaagggugacagacuaucccaaacaauagaugucaaaagucugauaacugauggucguccccuagccucuccacgcacaguguggcacauguggcacucacaggcacgaucgcacggacauaacaagcacagaagggagaaaggagucuugcugacuccgauuacuuuugguaaucuaaagcugugagacucguagcagcguaauauguaauggcuucucggcacuggugcugcuggccaggaaaugggaagcugcuguugagagauugcaguuuugaaagaucaggacguuguuacaacacguacaguuacggcauaguuaacaguaaguagcauaggcuuaaauuuuguugaggguagauauuguguucuugcuauaaugaacagagaugacacacacaacaaacaacaacaacaacaacaacacaaaaccaaaagacucaacacuaccaaaagccaacuaaagucuauuccuuuugaacggcuccuccuuauguaaccaaccaaacuuugcuucacugguuuucuguggucuuugccuuaugcugauccuuaggacguuacaaaguaacagcagacaccuuuccucuuuguugcacucaugccagguggccaccagggggcagaugaugcuugggaaagaacugaagcugagccguuugaagcuuguaccuaagcacaguuuguugguugggaggaguuuuuuguuguuguuguuguuuuuuuguuuuuuuguuuuuuuguuuuguuuuucaaacaggagcuacauuugguuuuccuuuacacugguauuauuugcauuauuucagcuucuuucugcacuuagggaaaacggcuaauauuuaaugugcaugggauagguaaugauaguggaguucaaauaaacuuuucuuaucuuaaauuuauuuauuuuuuuaauuguaaauuuauuuuauucuauguguguggguguuuugcuuacaugcaugucuguuuaucacaugcgugcaugaaagggugggacuggagaugauuguaagcugucaaguaggugcugggaacugaacacggguccucuggaagucuagcuguuaccugccaagccuucucuuaagcccguuaaaaugaaauuuuuaguaaacguaccugauuggugacuggauugguuauuucuuccuuuggguaguguaagcuaguggauuucuuugugacagaauaguuuacuguuaacaaaaacaaccccaaccccugaaaaaagagcccacccagaaaccaaaaucggacuauguggacaguggugugucuauuugugacaccaaucuuauuucucauucaguuuauaauuuugagucucacugauaccuuuuuaaccguaauuuugauagcauagggagagcuugugguuuuuuguuuuuaauauucagaauuuggggacagguguuuuuaacaguuuuaaaaauaacaaccugugaucuaacagaggaaaucaaagcuggaacgucuguuucuuugacucuuaauucaguggugugacccucugacggggaucgccaaagaccaugggaaaauguuaagauucauaacaguagcaaaauuacaguuaucaaguagcaaugaaaacaguuuuaugguuuggggggcccagcaugaggaacuguaucaagcuauaguaauuccauuguuguugcugguucuguuagcagggagguguucauucaggagguugguugggugugggugugcucgcucagccccacagugacccucuguggguugccauccucugacaggacaaggcauggggugugagcaagggggugaguugcuucaguucuccucuucuccuguccccucggauucucggaugcugugugggauuucugaauggguuuuuaacaucuagugagcuguuaauggaguaagguuuguugccuugugauauuguuuaccgagucucagaagcagcagaccugguacagggcuaacuuuucguuuuuaguguggcucucaauacaugagaauuagaguugacaauuugacaaccugucauuagcacaguaaaaaaaaaaaaaugcuguuuauuuuaaagauuggaaguauuuguugcuugaggguuucgcucuguuggcguguuuuucauccaaguaaugagguuuauguauaucuagguaaagcaccugggaaagugcccagggauaauagugugacccugugcaguuaaaaagcaauggaaucgguucaccgauugcucuaaugaagucuuauuucuuucuuucuuuauuuagccuagcuaauaaauagacauuaggcaugugaggugguuuauuucauuucgccccguuccaaauagugacaggaccugcgacaucauuggcuguuacauaaagcucccgagaccacccacuuucuccuccccuuuccaucccagucgggaaccacaacaacccgcggcaugcacagugugauguaauucaggcugcuugcuuccugagcugcuccucacagaucuugcucagacgaagggcauuguuuguuagcaacaucuggaagagcaaacggaagccuggagcucugggauagcuaacucuagcuacccccccccccacgcaccccccaaucuggguggccuggcauuagcauguaagcuuguuuuucucuggcuguaucucuuggccuggaagaaccccgaguugccaagagacacaguaugugauggucccuggaaaagcugcuuccccugcgaaguucucccacuggcuucgaagacaugcuguugucucccaaauucuccuuauccaccauccacguccgccuaaccgccaaaggacugcuucgaaaccuccggcuuccuucggggcucaggaaaaacacugucauuuuccacacagguugguccugcacaggucugcucagcaccgcgcgcggggaggggaggucggagauaugcugaugaacuugcucaugcuucucagguuucuauggagacauaauugggcacuaaagcccucuuuaaggagaggcuugacugguuacaaggagcgguaaucuccuguguugggcaggaggguacuuuaguugugugccggcagcuguaggcuugucuguguuuaccgaugcaggaugguugccuuggaacuuucuggcgcucuccucugccaccaaaucuguaaaaaaaaaaaccaaacaaaaacugaacaccuguuaauucacaccuaucuucaacugauuuuuggaaauaggcuaugagcacauugagacaggauuucucuuugcacugagaaaggagccgguuguuucugugguuuuguuuuacaguuuuucagauucucacuagaauggauagggaauaggaaaagagccccacauuacaaacaucccuaaaaucaccccaaugcuuguggagggccgguaaguggaccacacacuuaguuuucuaagucuuccuagcgcaaacacuuguggucauagacuauugcugcugauguuugugugcgacgcugcugcugcugccaccuuucauucugugcccaacgugagacauuccuggugugucugucccuucggcaucuguaagccugccugcucaagcucaggugcuacggauugcaaugguggugaguuaggucgaucucacugugugauggccuaagucuccuuaugcuugauuggggcugcuguguguugccuucaacaggcuugcuucguggucaugcgugauuuuucugugucacgcauguguuuccugugcaccucuuguuuuucaguuggcucuucacugucccugcugauuuuuuuuuuuuaauucagcugacagcuuuucauuuucccagaggcaucugccuucccugcaggauaaccuggauauauauauauauauauauauauauauauauauauauauauauauauauauuuuuuuuuuuuucuccccagcuucccuuccucauuucauaacucgccuuggccuggcauuugcguuggcuggccuuuccuucuagcucucauggcugaagguaaaugaacagagcuggggcuaugcccaauccaaaugccacugugauucccuucaguccuaaaauaaaaguugagggccaaugggggagcucaguggaugcugaggccuuggcuuuaauugcccguacccucaaaauaaaaauauauuacaaauauauaaaaagguaaaaaaagugugcucuauuauuauuacuauucuuauuaauuuuuuucauacaauuuucacccuauuauuucucagccuccccaguucaucccaccucccuauguauacaagcaagagugcuuuauguuaauaauuuccacguuccaaaauacaagcaacucucaauauuaauuuuuaaaacuaacgcagggccugcucuaagguagaagacaggugacauuucugaagaauagauuuucauaauaaagucagaaaaaaagaaggucugagggcacugugucauccaaaaguggcucuuucugccccggacccugcccucucucacuguuguggagucuugguuaccuuuccgaugguagguuagccagacgcaaaccuacggaagucuuugauagccucacacugacuugggagguugguaucuguuuuaguugcuggccuuuguaagguuaaugcaucuuugaguuucaugguucccuacuuccuccuccucuggguggaggaggugcugggggaggaacugggucugcugcauguuuggcuggugcucuacacacccagccuuuauuccagucgucuuaacagugcgaaccauugcugagucaacagugguuucguuguuccacuggcugauggcuuaacauuugauugucuguaguauuuuugugaagcagguaguuugagcaaaagaccuaaggcuuuaaagaccagaguuuaucuaauagugguguuuucaucacauauuauuuucugaguuuauauaaguauucuaaaauccuuuugcugagagucauaauguuuagaccuagaacacacuuagcagugagcgugcaccguauuuuacaccgggaagucugcggccuggacacaugaacuaacuugcccaagagcacacaguaaguagagaugggaacacaaccugugaccucuguuuagauuuuuuaccuuaaagauuuuuuuuucuccagcugcgacugcugcucugacucucagcaccagaaacuaggggugaaggugaaacaaguuaaguuucucgaaagagucugaggcugaggaauggacucgcucaguuccugcaguguuucccacacaaacauaaagaucaggcuuccaucccuagcacccauauaaaaguuagguguagugggguggccugugcccccagggcuggggaggcuggugcaggaggauuccugggguuggcuggucagccaguggagccaaauuggugagcuuuaaccucagggagaaacccuguuuacaaaaauaagguggagagguaaugcaaaaggcuugugagggcgacaucuggccucuauaccacaaagcucacuagugcaugcaugcacacauaggcacauagggcagaacaaaguauuguaaaaacaauaauuggcauuuuuuaaaaagacuacuuaaagaauuuaauucuaauaauuuucauuaccccuaguaagacucuuuagaguucaucagcguccuaucauuuuaaggucagagacauuuucuaaaacuugguugaagaccucauugcgcuuggcuuuaucuaauuagccuugugagcacugacauguuuauaucccuagucaaggaaguuccguugguugccuuagugauggggcuccugaccuggauuccaagaguagcaggaaaagauggcguuggcucuaccaguaacuuggccuaugauugucuucgcuucccagggccauaaaacggcagccccauguucuguucuccagucucugggccucagaugccacgaaccuccccagcacugggcugcacuacugcacuuggaaauuaaucuuaacuaccucccucccaagucccauuaacccucuuggcuuauuucucuuuaugacaucauguucuuaucuggucaccaaauaugacuaauuuuauuauucauccucagugauccacgacaacugguuauaaaaacucgagaccccacccuuggaggugauccuuguuuucacucgaccgcccucccucagaaacuuagggugaagcuugcucuucuguggggugaggauggagcuugggaugggaccugggaccaccugcauccuaggcaggugccucaccauugagcugcuaucccacacuggcucccguuagugagacaguagcaaaagacuugacagugaccgguccaugcagcuaacgaggggugggagcuuucuggaaggcuuccuauuggcuuaaugccaccagcuuuuccucugacucuaaccugcuucucacaucacaagaucaauucguucaugucucauauaaguaucuguugggcacgugccauaugccagacucaaggcuuggugcugagaagauagccaggacuaagucccaccacggccuuccucaaacccauaauugggcaggaggcagcuaaccaugcuaggguguggccugggcccucaggcagcucuuggcaccuuuauccugguguuucaugagugccuuccauauaaagagaauagcgugaaaaccugagagaggugaggacagguggcuccuucaaaggaaaaaaagugcaauauuucugagcaaacagugagagcaaauaggugagagagggaggcugggaaaggagccguguucagagccugggacaagggcacaggccacuaugcauugugguacauuguuacugacaggugugucacugaaucaagaugucacuguuuuccguaagggcuggaagaaggaaggccguccuguagcgaucuuguguggcacauaggugaagacugucaggaggaucaggaagcaauccugaaagucugguaugaucucgcuaguugucucgaguuucugucaagaguuauuucuugacaagaguauuaagcuaagccaaguguauuuucaguuuuuuaucacggcacaccaggucggucccaguuuuaugauggcgcagagaggguaagggaaauacacuucugaguauaaguacuccuccccucucagucagcuuuccuucuaagcuggaaguaaacugauguguuuauaaaaagauuacgagaggggggaaauguucuauggugguguaguccggcgugggggaaaggggaugccucugugggcccauggugaagcaccccuuucccccgccccccagggaccagccacaggaagauauaguauagaauaggguuuauuaaggacauggggaguggacuuaagaggguaguagaggcagagaaagagagggagggaggaaggaagagagagagagagagaaaagagagaaguagaggcgggccaugagcaaguggagagagagggagaaagggacaagaggcaagagagcaagaaggggucaaacagccccuuuuauagugagucaggcauaccuggauauugccagguaacuguggggcggggcuuagacugaaugcuagcagaaauccauauuaauuauuccagguuguauaucuuaauccucaaauacucugacuggaguaaaagcaguuaauuacccuaaggauuuuggguuguuugggcugagcuagggagauuaaaagugauuguuguaccaguagcaguuuccuucccauugaaacacucccuccagcggggaagcucuuuaagacucaggaagucccugaaacugaccagauggcacuaggcuccccccaccccccagcaguuaggacuccucagacccucucagaaaagcagagcugccagaaagagagguugagcugccugcuggccaggcaaugagccucugguugccagcuuuuaucagcuuuuauuuggagugggcuuuugguaauguggcugucuuugagucauuucugcuccuguaaauagcuccuuucacccauacuccuguaaguaaccccaauaaaacucaucugugcacugaguuggacauuggugguggucucaauuugauccauuguuggugcccugucugggguaaguagaugcuuguucacgucuccccaggaauaaugccuuacaacauuuaggcaagucugagagugugguuguaguaguaugccugccuaaugugcaaagcccugaguuugaucccagaaucugagauagcuuagcaacggaaggaaguacuggagacccaagcaguauuagaacaacgugccugaagcaguagcauagagcuguuugugaaugugaauucaccgcacgugaaugaaaucuauucaauuacaguaaaauucaucaaacuacauucuuauauuuggagguuacuucggagacuccuuuuagaauugcucuaggccugaaaaccagacaguguaagaagugacacacuuccucccgaggcagaauugugcugucuguggcucugaagccaggaugggcggcucugcuuuuuccuuagcucccuuccuaugggugccggccucaggcugaaagcaaaggaaacaggguggggugggguggggguggggggcaaguccuuuaagcuccagucucagucacauggcuaagaucuuagaaagagagaggcugagaaacugagugucugauuucuguaguuucguaagugugucuguccuccaaagaggccgggcaguuaucccucagaggcugucacuggagauuuaggaaugacagcgagaguauuuucuaacaaauggagucuauaacagaccuugcgguuuugguuuuuguuuucuuuuuaaaucugaaauaagacaaauuaguuuuggugcugauuauaaauacuuguaauaauuccacuuguuuuaguuugcuuuucuguuagcguaauaaaacggaucaaaaccaaccuaggaaggcagugguuuguugacuuacaagucacaguccaucauggagggaagccuggcagaaguccggaggcaagaacugaugcagagaccauggagaaacaccgcugacuugccuacccucguaugcucagcuaccguucuugacaagggacggcacugcugacagugaacugggcuccuugcaucaauuagcaauuaagaaaaugcaccuaggccaaugugauggcaccaauuucuuaauuaaggggcccucuucccagguaucuccaguuugugccaaguugaccaaaacuaguuucaacuuuuaagcuaguuuauuacuggacaaaauguuaauaccugacuguaguuacuuaaaauacuuuuaacuuuccauuuuaaaaauaaugcauuaaggaaaguauuguguauuucagaucugucuuuuauuuaguauuuuauuaguagaacauuuaugguguuuauucuauucaugugcuauaaauguguuuuucucaaacaccaacauaauaggugucaaugaagccauuauagcuaguucccauaauauauacauguauauuauguguauauauguauacacaucaauuuauauguaaaaacagaguugguuguucguaaaauacauaaagggccagauugaaggauaaccgaaaaguaauauauaucuaccacacuuuacuguccuaauguauauuuacaaccuuuuugcuuccuugaggaagccaccuugaagaccucacuggccucugaccccagugacagugguuacauaucaagagcaucagagaaucacuauaauuaaacacauauuauuuccagguguugugguacaugccuuuaauccuggcaccccgcagacagaggcagguaggaaauuuaagguuaccuugucuguauaccaagggccagaauacccagagaaacggacaaaacaccccaacaauauguauugugacacuuuagguuagcuuuaaagaugucuuagggcuagcaguguguacagagcuaagcauagugucaggcaugugugaucuuaacacuugagaggcuggggcaguauggagagagagaaaggucggcuguacuguaccaagaccuucucucucucccaacccaaauaagaagaguguaugcacauugcuugcgaucuuggguaaaaagacaguaguugggguuucugaugcccuuuucugcauucccauuaucccuacuuucauuuauuucagaaguacuuuuuucuuugauuuuuguugcucuggggaaaaguagggcuuaaaaauguuuuugggacuauauuaauuacuuuuuuauugcugugauaaaauaccacgaccaaggcaaacuuuauuuugaaaguuugucuccuuuauucauugcuuuacaaauuccacggcucugaauucgguuugucccaugacagaugagaaaaugcugauuuuuaaaacuauaagacuucauacuacaauguuagccauccuaagucuuaagucuaugaaaauguaggaacaucaaacguuuugaaauucaaaaucuauuuuuuaauuaauuuaauuuuuuuuaacuuauucacuuuacauauuucuugcuguucccucccggucacccccucccagucaccuccucccacaacccuuccucacccuggcacuucaagucucugugagucuaggcacuuccucucccauugaggccagacaaggcagcccagcuaggagaacauacccaaggacaggcagcagcuuugacggaggcaacuuuuaaagaaaggguuuccuugggauuauggcugcagaagauuggagucuacagugacugggcauugaccugggggcagguggcugaagaacagcuaagaguucacgucuuguuccacaaguggcaagcagagagugcuaacugcaagucuuuugaaacuucagugcccacccccugcuaauacaccuacucacucuccccacccagccaccaacuggggacggaguauggaaagccaagauugauggugacuaucucauugaaaccagcauagaguugagagauuugcccuuucccccgugucucuccccuuuaaccugguucuagaagccucccacaucaagggcuaguauucugagaauggcauucucuuuuacuuuauuguuuacaaaaauacgaaguccuaacgucgaagucuuuaccuggcuaucugaaguuugguuucuuuuacaauauaaucuucugugcuucaucaucauaaugagguuuguuggguuugggggaggggacgguuguuuuguuuuggcuuggguuuugaacaacuuuugauacauuuuggagagccugcuaccucucaguguguuaugucugcaagugucuacacucagaaguauccuuuuaugauaaauaauggcaacauaauccuagcacuggagguaccaucugaggcuacacagcgcccacccgcgggguauggccuuagagguggaagugacauuugagcuggcuuagcuuaggaugcaaaaaaucacaggagacaugcuauuuaccagcuuuaauuacuuuggaggaguaacuacaagaagaccccggcaagcugcuaugccuugcuugggagaucaguuccuaguggugacaggacauugagguacuauuuccuuccauguguuuaauuagaaaggacacauuguuagugcauguugucauuggcaaaaauuaaaaagacacuccuggcauaagcagacuuuguuauugaguaguguuuuaagucucuaguaaaauuggcaaguugaaaggauuaagauaaaaacaaaccaaaaggcccauaaaaaacuacaguuaagguagcgauggcaucguggggcgugcuuuaauccuggcaguggggaugcugaagcagacguaugucugugaguucaagcccagccugguauucuuagcagauucuaggacaguuagaaguuauguacagagauacugucucaaaaccaucaccaccaccaauaccaacaaacaagauugagauauaccucagccaguugacagaacuagaauguguguguccagacuccugcguguugcaggcaaucuuuaggcucuauagcaccuugagaaaguuacaaggcaggugacuauucugaagagcaggugaguuuaggaugggcuauucuuggagacucugggagcagagugagagaagguucuaacgccuuccucacaagccauuccuaacuccugacuccugcccuugcccucauuucgccugucauucugaucgcucccagcuggaauccugcacugcaccagggccucuuaaucuaacuggcuaugugggccuccuguuccauccuguucuucuccugccuguucucacagucuugggccccaacuuuggugcccucaggccucccucccgaccucucugccucgauuuugccccuucagaucuuccuucccuuccccgggccccgcucaucguuguuuuguuuccuacaagauaaaaucuugcacagugcacauguccuugcuccuguuuauauuccuaucagcuuuauuuuacuuugggauugaggggccuuugagucucugccauuguguuuucuggcucugucuucaguuccuggcuaccuccuuaauguuucugucugccacaugggcaaauuccgucaagacucuaccuagaacauucucugccugcaccccaccccacuguguacaugacuccaguaucugauuacaauaccauuucacauucccaagcauggugacauaccucugucugcugcgcaaguuucuucuauaaaaaaacaaaacaaaacaaaacaggaccaguuuauuaggaugcauuguguagacagcuacagaacaagccgcagccauuuugauaaccguggcauaucugggugcucauuuauauuagaaaacgaucccguugacucucauguuaauacuuuagcuuucuggaguguugcaccacaaacauucccaucauucaaugcaaaggagaugccgacugcaaaagcaaguacaaggugcuccuguuagcacuugcagaugugggguugauaauagugcaggagacgggacucguccaucugucuaggcugguggagguucagguucucuuucuguaucacagagcaaugcuauccucggagacggccugcugggcccccagugucucucucuuuggcuuccccuguuaugguagauuguaucauaucaaaguuggacaugacccaacaggagaaagagagucacaagagcaggcacaagagucagagauccacucguucuuacagucaggaauucuauggaaauacuaagcuaacagcuaugaucuaaaugcugagggucuaguguagacucaucuaggccccacacuaguugcuucagucucugugaacuccuguguaccuuacuuacuugguugauucagacugccuuguucuccuagugucuuccaucccuucugacuccucuucccaaagguucccugagcugugagggaagggauuugaggcagaaaucccauguagauuaucucucuacauaauguccgacugugggucucugcaucuguuuccuccuccaggggaggcuucuccaaugaugaguggauaaagaacugaucuaugaauauagaagaauaucauuaggaguaauuuuaucgauacuuaaaaaaaaaaagaccagucauucauauuugauuuuaccguaggucucugggucuuugguucuuagguucuuagguucuuaguuccuuuccuugaguaagcgucaagucaaaucagauauugguugguuccucccaaaaguucugugccaccauugcccuagcaaaguuugugggcagaauggaugguaagccaaagguuguuaucuauguuuaucuuucuguagucugcagggcaccuuucugccccaaaagacgcuagcauguagggucaaagcaucugugugagcacuagcuuuacauccccauguucagugacuuguguggguguuguccucgguaauggggccccacuguuggucuuuggagagcaaccauuuaucuuaccaauagccuguguuguuuuggaauuuccaugggacccucuucaacaacucaaaugaaugcagcucagucccaucacuggcaacugagagcucauuuucccuauuacaaggagccccaacuaagauucccuucaucaccccaggaaguuugcacugcacuagguucccaaaugucucgauuccaggccucucucucccuccacuccaucuccccacaacuugaucuccauuuuccuguccccaucagcccccaaucugccauaaaaaucgauuguuuucccccucccagggaaaucuauguacccucccagcccccacugggcucaugccucauaccuaaccugauucuacagauuguggcuugguguuaucaucuacuuaaugucuaauauccauuuauaagcaaguuuauaucauauuucucuuucucguuccagaugagcucuucuuucucugguucauuagccugcaaaucccaugauagcauuuuuuuucaauagcugaguaauucucuauugugauauguaccacauuugguuuauccauucuucuguugagugacaucuaggcuguuuccaguuuauggaucuauucacauguauuacauacauuauacaugcacacauccaguuagacuagcaccauuuguugacgaugcugucuuuuuuacaguguguauuucaggcuuuaccuaauaucaggagucgauauggguguuggaucaaugucuagaucuuaaguucaaucccauugaucaacgugucuguuuuucugccaguaccaugaagguuuuauuaccaaugcucuguaguauggcuugaaaucaggcauggugagaacgccaguucuuuuauuguucaguguuguuguaacuauuucuggguuuuuuguuuuuccauaugaagcggagaauuguccuuucaagaccuguuaagaaugguguuggaguuuugauggggauugcauugaauguguagauugcuuuugcuaagauagccauuuuuacugcuuuaauuauacugaucuaugaucaugggagaucuuuucaucuacuuauaucucuucagcuauuuucuuuaaagacuugaaguuuuuauuauaugugucuuucacuugguuuagagcuaacccaagguauuuuauacuauuugaggcuauugugaaagguguugguuuuccugacucuuuuuuucuaaguucacuugucauuuguauauaggaggguuucugguuguuuuuauuuuuuuguaugcagcuacuuugcugcaaguguguuucagcugagcucccugguggaauucuuggggccacuuauguauacuaucauaucaucuacaaaaacaaaacaaaacaaaacaaaacaaaacaaaacaaaacaaaauacuuugacuucuuccuuuccaaucuguauccucuugaucuccuucaguugucuuauagcucuagcuaaaacuucagguaauauauugaauagauacggacagagugaagaaccuuguccugucccugaugugguggaauugugagcagauauuuuuaguuaaagcuuucuggaggcccgcaccaagccugaggugacucagcagguaaaagcaccugccaccaagccugaagaccugggcucaauuccagaacccacaucuuguucaaaucugugcacaaacaguuuuguuuucugguuugugcuuuaaaauuacuaaagcuauaguacauauggaccagaaguggcaguggcaguuuguugauaauuuauuuuuuugauuuuuuaauccuuuacucuuauaguucaaaaaauuuaaacacaaucuuugugcaaauuuagauuacauuuuuguauuucuaugacauaccuuuagcauuuacauauagcuauuucuuuucuuaauaggaauuugaauuuggcaacugaauguauagugaugucuuaagaaaaauuaaucagugaauauugaacugauagauuuauauacuagauaagcaccaggcacagaugacaacacuaauauaaugcuuauauaacuagauauucaaaaaugcaaauacaagaaguacuuuccuaaauauauauauuggcaauucugagcuuaauugaguuaccauuguaaguacauuguuuuaucaaugccuucauguagcaaauacccuggcuagaagauaaauaaggcaagcaagaaauaguuuuaauaauucacaaaguucacaauauaauguuucucaacugagauaacuauucaggguuuuuuuaauuuuuuauuuuauuuagucuuuuuuuacaguccagauuuuaucccccuccugguucaccugacuguuccacauccaauaccuuccccucccuaccucccgcccccaucuccaugagaauguccccaccccaccagaccucuccacucccugggcccuccagucucuugaggguuagaugcaccuucucugacuaaguccagaucugguaguccucugcuguauguguguugggggucucguguaagcucauguaugcugccuaguuguugugcagugucugagagaucuugggguccagguuaguugagacugaugguccuccuacagggucgcccuccuccucagcuucuuccagcuuuacccuaauucaaccacaggggucagcagcuucuguccauugguuggguguacauaucugcaucugacucuuucagcugcuuauugggucuuccauagugaggucaugcuaggccccuuuuuguuagcccuuuuugugagccuuaguaauagugucaggacuuggggccuccccuugagcuggaucccaauuugggccuguugcuggaccucccaucccucacuugaugcccugacaaucccaucccucacuugaugcccugucuuucugccggaggugggcuuuacaaguucccucgccccacuguagggcucuccccauuuaaggucccaccuuuugaguuuaaugucucaaauuaaauggauucauugaagucagaucuuguucuguuaauacauuacauagauaugauaaaccaaaaaagguuuaucuuuuuaaaauacagccauauuacuaaaacaguaacuuccauagucugauaaacauguaagggcguggaaggagagauggccagagauugcuccauauuaugcuaaauuuguuguguaaacaguaaagcccgcagggcucaggggaaacccuuggcuuuucauguugcagaguaaccaacccaucuaugugagcuuugagcaucacuggagauuuucguauucucucugauccucaggaaugaggacagggaaagacgugugaacugggucaucggcugccuugcaggauugcucuccugagggaguacaguauguggagcgacgauugaggccaccgcgugcuuguccagccccaaacacagggcacagcgcaugcacaauggaaagcgugguacucucggaaaacaagucgcaguccuugucguuuccaccuuaguugucaguuuuguucaagcccuuaacagcaugugucuuuaaucucuugucuacauugcccugggaaagacucugaguagacuauacucucuugcuggccacguguugaguaaagauuuaagugcuuauagcagagaugcauuuuuaaaagagcaaaagacaugaaaaugacuugaaaugucuuaucauugugacuucuaguccuuagcccaaggagguuaaucacugcuaguaguuuuauaugcgguacuuucaugagguauuuauaaguccccaggaauauuagcgaguauuuucucuagaauguuaacauaaaagauuggccucagacuggagauguagcuuagugguggagggccgaguaugcauaaggccccagucugaucccggacauuguggggggggaagggggcgcaguugagagcuaccguuuaaacuaacagucaucuguuaguuucaaaagucugguaaguuugcuacauuuuguuucuaaguauguaacaauguaguauguaacaauuuacauugcuauucgguccaguuuccagagugugugaggauagcagacugucgguguucuggauuuuaaaugucuguccagaguuguuuacacucaccugaacuagccuuacccacccuacaaagguaccagaaggaucaggauaggggauagccuggguggcacgugccuguagucacagcugcucuggaagcuacagcagggaaccaaauuccugagcccaggaauuugaagcuagccugggcuacagagagaucaaagcucaaagaagagaggaaaaagaggaaauacucugaacuguaaaugcugacauuguucuuaucuauucuguggcaaauauaauuucuuaguacauuauaccggcuaauuuuaugucaacuugauaccggcuacacucaucugagacaagggagccucaacugagaaaaugccuccauaagaucaggcuguugggcauuuucauaauucauucuuaauuagugggagggcccggcccauugugggguaguaagcagcacucccccaggacacucaggcuucugcccaauuugaguuccuguccugacuucccucagugauaaacuguuagaucagcaucugaauggaaauaaacccuuuccucccuggguugcuuuggucaugguguuucaucacagcaauaguaacccuaaaaggccacuguuaaggaacggguacauggaaaauguagaucugcuguuaaauauuuauguuuuugucauuaauauagaaagugauucauaauuuauuuuucuggacuauuuuuauggcaauaucaagcuuaauauauagucuguaucuagagaaguggcgguuagugacaaacaacuugaaaaccccaucccguaaagaaugaggaauguuuuccuggucucuugaguacuguaagacaacgggaaucuuagucaguuuaaaagugaggcuuaucaaaucuuagggacuguuucaccacauaaaggagccacaggaaacgagggcgcuuuuaucugauacuuaaaauauuguuuugccaggugugguggcacacaccuuuaauuccagcacuugggaggcagaggcaggcagauuucugaguucuagaacagccuggucuauagagugaguuccaggacagccagggcuacacagagaaacccuguccugaaaaaccaaauauauauaguuuugaauguaacguauauuuaaauauuauuuuuaguguaagcaagagcaagaguaaccccagagcucuucaauccagaagucucuuuccuguuucccaagcauucuuggaugauaguuuguggauccuuuaaaaaugagaggaaaaccuugcugcuuaaaaaguucugucaaaaauacagaaguggaugcucacagcuauccauuggacagagcacaggguccccaaugaaggagcuagagaaaguacccaaggagcugaagugguuugcagcccccuaggaggaacaacaauaugaaccaaccaguaaccccagaguucccugggacuaaaucaccaaccaaagaaaauacauggugggacacguggcucuagcuacauauguagcagaggauggccuagucggucaucagugggaggagaggcccuugguccugugaaggcucuaugucccaguguaguggaaugccagggccaugaagcagaagugggaggguuggugagcaggggaaggggagagggauaggggguuuucagaagugaaaccaggaaaggggauaacauuugaaauguaaauaaagaaaauaucuaauaaaaaaaagaaaaguucugucaaauuugucagugcagaauguggauggacggcgccaugggggcugguugucacaauaaggaaacauuuauuuuacuuuuuuuuuuuuuuuuuuuuuuaguuucaugugccuuuuuuuuuccauauuuauauuuguuuugauugcugggccuguuuauuuccagacaccaagcaguaggcuuccuguuuuacccagagcaacuugacguuuggaaugcuuccaaaacugcaagaaagauuuucauuuaaaaccgguuguucccagaacacagcaugggaagugagcaaucucuccaaacguagaugaaucuggaauaguagcaugcauuugagaacauuuuuacacucuuuuuuuuuuuuuuuuuuuuacuacacggggaacgaaguuugcgcuuguugaaaaaugaggcaguguauccaggcgcacaggcacacgcugcuuuucccaguaaccucggaggagcaaagugcaggaucuccaguguauaugcugggucauuagauuucggugacaucugcagaguagacugugacaaugaccagaaagacagcggggaagacagcucugugggagguguuuguggaaaggguacagggggcagugagguaaaggaggaaggguuuccugggaaaaugggagggcuuuaggguggaggaggcagaccagcaagcaacugugaagaacuuacuaaaacuuaaacaaaucaucuaugaaauacuauaaugaagccuauuacuuagcaugcugacaaacaaacaaaaauaacacauguacucauuuauuugguggcagggucucagugcgccuccucaguuggccuacaaaaccucuguagaccaggcugucuuggaacucagagauccaccugccuccccacccccagcccccaagcaauuaaauuaaaagugugugucaccaugcccagucuaacaaauuuuuuaaaaaggagccuucgagaggaaagaaaagcauuucaaguccaauaaucagaauuuuccucagugcuuaucccaugauuucuuuuuucuuuucuuuucuuuuuuuuuuuaaaucucugcuuuuuaaucauacccuuucaucgucuguuugaagacacaaggggauuuaaaccgcauccuagauuuaagugcacuaccggcuagcuucagcauuucuccaaaaugggaaaccguuugaauagugugucuuaguucugccuacuguauaauuguacuuuguucagccugugucaugagugcagugccacucuuguuccuuuucgucaccugguauaauuuacugcgucacugugauagcagacucacauucguucucucucccccugcccccuuacauacacaugcgcguaugcacacacaaacggacucaaggacagaaaucgcgggacuaccccaacagacacaggaaaggacuuucagauuugucaacuuaacuggaagaguaaaaacuaugaaguggaguuggagggauggcucagcaggugaaagugcuugccaugcaagccuagugaccugcgcuugauccuggaacucauaguaaaaggaaaccagcucuaggaggugguccucugaccgccacaggaccgcaguagucuuugagaaccuguacucucaugcacauaacaucaugaacacagacaacaauggugaauuaaaaauaaaggccacgaagucacuauuuugccucuucccugccuccaguguuuuauguuucugaguugcuaaaucuguuuggcucaugugcauaacuccccauuaaaucuucacagugagaacuaaagccauuggcccuguugacgaguuccacccauccugauccccgaucuacuccagccugccaccauguguacgucccaacguaaaacaugguucagaugcucugguguggcggcaguaggcugguugugagccccauguggugguggugguuauaaaaauuaguuaaccucacgcgcaucuucuuugugcuuuucuuuccuuccucuugcaguugaaaagggcaggcagaagaaucccaggagccuaugcauccagacccagacagcuccagaugugcuguccuccgagagaacgcuugaguuggcccaauacaagacaaaaugugaaagccaaaguggauucauccugcaccucagacagcuucuuucccgugguaacaccaaguuugaagcgcugaccguugugauccagcaccuccugucugagguaaggacgucuaucaacccucacuggugggcggcggggaugcuuguccuacaaaugugcuuaacuuagugacugcaagagcuagaacucuauuucucugcuccccgucucucugcgccccaauuccugugugugugugugugugugugcgcacguguacucguguguuuacccaugugcguuuauggugaagacuagagaaaaaucucauuuauuuccagggagccaucuaccuucuucucgagacaggguuucucacuagcacgaaacucuacucguuggucucucuggcucgcaagcaaaucccagaaaucugccuguccccacacccccaauacuccagcccucaaaacugccuggcuuuuuuaaaacugaggguccuagagauuaaacugaggaauuuguguuuaugaccaagcuaaccccaugccaugccccaaacuauaauuuuaucacccacuuucuacuugugccagucucuagauggauuuggaguuacaauaacuuucuguuaucgucccucccuccuuuucuuugugugguggacaagccuguggacaagccuguguacaugcgggugcuggugcccaagcaugcagaggcuagagcaggaugcugguccucuaguguuaguuucugagacacgguuccucacugaaccuuuaacuggaaauuucagccaggcuggcugcuggccuagaggauucccaggacccaccugacuucaucuccgaaggcugugguuauggacacucacgaccaugcuuagcuuuagggcauuggagauuugaacucagguccccuugcuuugacagcaagaacuccuaacugcugagccaucuccugcaaauagguucuuuuuuuuuuuuaauuuuauuuuauuuuucuuuuuacacuccguauuccauucccugccccacacccccauccacccuccgacugcucuauaucccaugacuccucacccuccugucucccuguggauguucccacccuccaccccaccugaccucuaaacucccugggguuuccagucucuugaguguuagguucgucgucucugaaugaacgcagacucggaaguccucuacuauauguguauugggguccucaugucagcugguguuugguguccagugucugacaaauccggcuuaagugacacugcuuguucuccuauaggaucggccuucucugaaaauaugcucuuaugucccuuucccucccagucucuucacuggaaagaugguaguaaaaugauaauuggccuaugcuauuuuauagaacuccagauuuacaauaguaugaaagucucauuccacucguuuuuucuuuuuuuuggucuaaauuacauacacuuucccucaugguuaaugcuuuggaaucucccaucugacucucuuagucucucaaaggaccucuuuuagaaagaguauccuacagaauagauacauguaguguuaauaagagacuuuuuagcuggguguggccuuuaaucccagcacuugagaggcagaggcagguggauuucugaguucgaggccagccuggucuacagagugaguuccaggcagccagggcuacacagaaaaacccugucucaaccccccacccccccccaaaaaaagagagagagacuuuugggcccagaagaagugguuccuaaacccaauccauguaguucaucaggggcucuguggaggaacaaauagauguagcccugaauuaaaguggcccuggguuugguauacugaaugauacacaauauacaauauacccuuaaggaguuucaagagccuuuuuguaaagauccauguuuuuuuuuuuuuuuuuuugggguccauugcuuuugggugaggcagaacauccugacaggaagcaagugauggagauagugacucacgccaucauagacaagagaaagagagcaagagcaagagagagugagagagagagagagagagagagagagagagagagagagagaaacagcaagauaauaaaacagagagaaaccgaaagagacacagagagacagagagacagacagacaaagagagaaagaaaaagagaaaggaagaggccagacacaaacuguacccuuuaaaaccccacuuccaaucauguucuaccuccuaacagcccauucagcucugacaccuugagaaaacuaauccacugaugaaguuagcguacucaugauccaugucucucaacaggaccagcaugcuggggugucaagcuuucagugcccgaguguuucuuuccaauccacagcagaauggcuguguaacagugaccuuaacgaauaucaagcccaugggcccccuccuuaaggagaccccgggggcuucuagcucuaucuuuacccacccucuggacuccaggaucuuauacuuccuuucuauaugauaacuccucacucugugcuugcuucugcuuuuaaaagaaauagcauauuuuauuauuuuagguguuugucacguguaugucuuugcaccacuuacaugcggugcccacagaagccagaagagaggguacuggacuuucagacaguuguaagcuguccuuaguugcugagaauugaacuugaccccaggguucucuggaagagcaagccagugcucuuaaccacugacucauugcuccagccucuguuuuggcuccuuacgaugaaaguucauugauagcagagucugcuuccaguuccuucuuguaaaaccaccccaagaauugaaguugacaauucagacaguaccugaguggacgagcgaagggcgaggguggaacugcagaaacaucuuacaagagcacacagaauccccauguuggauguucuccaccccuucucuguuuuauaauccaucagugaauguucgcuaguugccuaguguguacaaggcacucacuguuaggaaacagcugaaagggaaaggguaaguugagcaauuaaaaauccccuuaacccuuuacagagaucucuuguacccacuguugaaacauuuggauccuauuaaccagcauugcuguuaguaacccuagaguccucaucaaagggucucuaggcauauuucuugguaagguaaaacaagaccagauagguuuuuuuuuuuuugcauauagaaucuaaccuaggcuaguaccucccccccccaaaggguuuuaaauuaugcuaauagucuacaucucagauuuaaagggguggggugggggugggagcaggcaggaugagggagugggugggaaggaaguguccacaaugauaaaaguaugaacucucugcagcucuuuccuguaauaguuccuguguugcugaugccauucaguagccugcagaagucaggcacacuggcgggacgacagccagccacuaagugcuugcaucccagagacccuaauuaaauuacggagaaucccguuguuguugaguuuuuuuuuuuuuuccuuaaagcgcuucauauauuuaaugcaugaguuugaaagcaucuucguguggauuuccaccuuucucucuagucucacuguguguguaugucuguggggcgagggugggguugcauguuauaguacaaagauaaucaaauaaaccucuucucuggauuauaaaugguuuaucaucuaugacagagacacuaaucuaagcagcuggaaaaaaaaaucggucucuaacugccagaauguauuuuaucaucuugaguaaauaagaaguacauuuaaagggcaggcaacccagacagucaugcagaaacuaauaguaugucuguuggagucugggcucuguggucugcauuuuugaguagaucauauuaaagccccggguuucccauaguccugcgcugcuucgccucagaugaugucaucugcuuugauugaugaccaaagaauugguccuggacauugcccuccuaaguaccaggcuccuugaaggcaggagcuaugucuuaauuuucuuacauaucauuaugguauaggauauaaaaugugcuuagcuauaugaguaauaacucauaauucagaaagauaaaugucccuucugggcauuuggggggaggggauguuggcuuuccagaaaguguauaaaaugagucagguuaagaaagcccgucaucccaagaggguagcauggauucugggaaggauagcuuuugacuuggauggaagaucucgggaugcuaaacaggagcuaggcaauucuaguccaugggagcgcacacaagcacacaggcuagcacccacucaugcuugcuacacguauguauguaugcuguauuugcuggaggaagaaauuccgccucauguaugggugcuaccugagcuccaccuucagucccagugucauuuguaacauacucaaaagagaagggaguuuauacacagaaaauauugaauaacagcccucuaggguauaaagaaaccccuucuaugcuugcguacugggcucuaaagaaccaggacuagaagcaaaggugacaccaagggcaaaaagccauugugaaggaagagugggcuggcuuucccccacccccacuuccggccauugagacacagugacaacugaccuugauguccucacgcuggaucuugcuggagaaggcugagugugguuuagggaagugaguuaggacagaugucaacacucacugaaaucuguugccuccugaaguccacuaauaagcuaaccaccccucccucggguguuucuggagggagggagguguggcuuuccagaguccuuuagagauaagcaucaguagcgucagcuuuugccaucuuccuuuccguuuucuugugcaagugguaagauuuccuuguccuuuuacccccuuuuguuugcaacuuggcugcugugggaaaggggacucugaagcguggucacaguuucaugucuaauagagcuguccccgcuuuucucucacgccacugacagacucugccauuuauccaaagcauuugaauaaaauuaaggcuugacgugacaguacucgaauagucaggcuguaguggcacgugccuguaaucccagaacuugggagacuggggcaaaggaaagcaaguaugagacccguaagaaggggagaaaagagaaaaacauuguaucuguggguuauuauuuuguuguucucaaacuuuaguuuuugcauuacaaaagcaaucguuuauuuuugaaauuuggaauuccugacuggugauuucaaauauauguaauccccaauacccauguauuaucaaugaacuauacucuauuguaauauuauuuaaaguucuaaaucacagcagggcccccugggugcccuucaccaugagguucaucaugccuuuaguauauggguucugaagagcaaacccccuuuuucuauuagugagugcgauaaucuaaugaccucaauuagagagcggaguaaaaaggcucacacaucuaaaaauaacuccauuauccacgcagagagggucccguuucuguuuccucugcccccgcugauauuaaguaagugccaaucgaucaggauaaugucuggcucucguuucucauaaaugaagggcuguggcuuuaaguaaucauccguugcuugugccagagacagaagcugcaguaucagcuucagagaggagagagaggagucugaggcaguaaccugcgggacaggcggggaggccaccagggccaauggcgcuccucccuguggagcuuugaauguaggcagacccggacggacggaugggugggaggcguggccaccugugcgcuucuuggacagugcagggggugggggaguuggagagaccggagcuggaaaaugggcugcccuagcagcaaaaugugccucucuccucccugugcagcaacaaggguaauuaguauuuguuuacagggcuuuucuagaagggugucagggacuacguacugcagacccugucuggaaccagggggaagugcuuugagugagaagcaagucuagacugcagagaccagucucgugcucucugccauacugcaacccagaugccggcuggagucccacaucuaaggucaucucaggaagugcccuuccugaaagccuggacauucucucacuuccuaguuucacccuggcgccagggacucuccgucuugaggaacugugucuaaugauuguguuuguauaaguauguguggaugugugccugcuacagaccugaagguaacgugaaaauuauuccuuaccgcaagacugauacuuguuauucuuuaaacccugaaacacccuccugauuucuuucacuucacuucucucaagccuauuuagaauuauaguugcuucaugauguaagaguccuuggaaacugcuguguagcugggugaaaucaacuugauuucaucuuuaagagauuaauuuuuuuauuuguccuagcuuaaaagcaaacuuuuuuuuccucuuguucagaauauaggcuuggccuuguaacaaaacuuuuuuauuugcggacaugggacaaagucuaucuaaaugccuauguuuagaacauuaaauauuuaucuugaacugauuaggcccuuauugcccuuggaggggagagugcauuacaucuuaaguacaguaugcauuagcuucaagggucuauggaucuccaguaagugcauggcgcaaagcaaauauuuuuaaauagccucucuuguuccucaaaggaaaguuucaacaggaccugggaaaauacagauuuucuuuuuugaaacaugaaauuccuucacagcaaagggacaucuggguuuugcuuuguuuuuaacaacacaaacuguuagcuuagugauucguaucucggccucucaacucugggucucauuuucccagcagugguaaguguguacuuuacugaaagggaacccucuuuaaacaaacaaacaaaacaaaacaaaaaacguuaguaacuugguguguguuuucugcagcgggaggaagcacugaagcaacacaaaacccucucucaagaacuugucagccuccggggagagcuagguaagagccuguuuuccugccccugccccugcccuggguaaaguuuacugaaccugagcaaugugcucuaaccuccugcucuguggcuggaguuacacagcggacagcuggucuuucucccucucucguaucugugcagacacuuacuaucgacacugcuuuugaaucuuggcagugugaccucaagcucacaaaauuccuggcacugcucugagugagcuaacacucacuuucugaugaccaaggcauaaagcauugcuucguauggaguagacagagacagaaugguuucuguauugugugcauucccauugaauaauuauguuugucugucugucugucuguuaucugucucucuuucucugucucucucucucucuguuucuuucuuuuucuuucuggaacgacuuuuuauauuaaagaguguuaagaaaaagcuauucucugauagaagugauuacguuacacauccccgcugugguacagcguaccugugaguguacagugagucuacaauuaaaggaauacugcuuguuagggccacccaugcucugugcuccuuaaguagucgggaugagcuggggaggagugucuaccaacucgaggagcggugugcucuguagcauucucuaggaagucuugcuguuugaucuuuugaguucuuggugccucugaggaucccuagauuugaaggacaaagacaguugcccuuucuaccuggauuaccuguaggagagaucggucugcugugccccccuccccuugcccugucuguggggaccacucacccuaagaauuggcuucccgauuuagcuucaacuagaucuggaguuguucagcaaaugucaccugccuuguccuuggcuuugcuugcugauaggcuguguuagaagcauguguagcauaaguucuucaaagggaacagcuaaagauagaauaaguuuuguucguuuaauucucaaagaauccuguuuuucucugagaaccagacuguaguuuaaauaccgccauucugauuugcuggacaagaauauuagucagcaacugcacuggcccagucaagacaaaggucaugggccaguucauguggaggcaagauugugcccuucccuacuccuuggccugccaguugaagucaaggccaauuccucgcuaacccuugagauccacaacaguagagaagccaccagugcuggcuggcaucagguaacagaaaggacgaacccuuguggaacaauaauuuuaagacagaugauaaaguacagaagcccagugaugggugagcucuuucgaaccgggacagaaggcacagcuugggugaccccgaucccagacaccaugaagaccuuccacuucuaauucagucuggcugccucccuuuugguuacccaaugaccagcucgaguuguuucugugccuuaaguacgguaauggauacagaauaaggagacaagggagaagguauuuuugugugaguuucaguguucaucggaacacaguggaaguggagaugagccugccuaaugauucagguuucuauucuccgagagaaggcaggaccaagacagaggaggacacugagcccauugacucugauugaauggugauccucuucagcauuaagcaguuuaaauuggagccgagguccaccacacuugcuguuauugugcagccugucaggaaacagccagccuuugucgucucaccucucuguccaugauaaggagaacguggccugguguguuuuuccugcugcugucaaagugucaggauguuacagguggccuguccacauuguuuugucacccuaggacuggacuugggaaauggugucauuucuguuaacuacugaaucagacaggcuugcucaaggaccagugcuugcuuaagggccagcgaaggcauuugggaaaagguugguuuggccagcgaauagaagaagaaaaccuucaaacaaguauaaugaagcuggcuccaaagaaaauucuuguagcuuucagcuggauuuguguuuugggccagaguggaaaaaagauauaaguuuauauaugucaaaaccguuuuccuauuugagggaauaaaaugugucgcacuguggucucacagucuccagguuugaauccuugguuugggagcuggguggcucagagcccaucaugucacaucucuucugucccaguuuuauuuucucuaaagugacagugugcaugugugccccaaggaugaucaugaaggucauauuagguaaaacuuugcaaagcggccauaccagguguuaacugcuauucgccauacauacacgaauguaucugguauuaaguuaaugucguggugugugucuguaaucccaguaacuccagaggucaagacaagaggauugcuaccagucccaggccagcauagugagugaaagguuagucugacuacauagugagggccuaugccaaacacacacacacacacacacacacacacacacacacacacacacacacacaaauacacacucacagauucaguuuugcaggcguguagugauuggugaaaugccuucuuaugaaagcauaaacuauaccgugggaaggacuagucaguagaugggauacuauuagagaucccucgggacagggagacccgaccuucgcugcuauuggcauuuaauguagguuagaggaaugggggauuugguuuggucuggucuggucuggaacucagucuguauaccagguuggccucaaacugggagauccuucuaccucugccucuugaaugcuggaauuaaaggugugcacucucacugcccggauagagauacaggcuuuuaugcauacacucccaguuaggaguuacuuauuuuugaguacacaguuuucccuuugaugaugugucuguguauuuugcugaauuaguguagagucugagguaaaguauaugaggugguagggccuaacccccgaugcuuuuuauaggcgacuuagagaucugaucuuccauccaucacuugcaccauccaaguguccaacuugucccuuggacuaaccaggggcugucagagucacuggucagcugugaucuuuacugugucccugaaaacugggacaagagucucacccuugaagaacuaugaagggugaaagagacucaggcccaggaacccugcaacugcaaucgucuguaccucugcccuucacaaucuaauggcuuccacccaucuuccccauuggcagacuuucuggaugcccucauuucguccucuaauagucucuucuuuuugucuggcacacaaccagcauguuucuccuaucugacccacaucccuucguggaaagcccuuugcuugggcgaaccucuuugagaaaccccucugucucaucagaaucaaaccacaaggcuccccuacaccagugacccuccuaccuugcacugauguauuuaauauauccuguguucuucuguuaucuccagacuguauggucuucacaaugaggagagucucuccuacuuccucuuugaggaaaaaaucguaaugaacucuccauuugcauagcguaguggcuuauguuuauuggcauuugagaguuuaaaccuuaaagaucaguguauaaacaagaaauacucuauaguucuucuauuuuggcauacuuuugcauagcccugugccuuuguuuauagaacauguauaacuuuguaccauuauuauuucaggaaagccuauuuuauauacaguaauaucuauuguaccaucacauuuuugcuuauuugaaacagggcagcaauguguagacuuggcuggcucuaaacuagaucuuugugccuuugucugauccaugauauuuuuaaaaauuacauuuauuugcauguguuacccacaugugugugccacagcagcuucguggaagucaggggacagcuuucaggauugaguucuucccuuccacccuaugggucccacccacgaacucugguucuucgguuugguggaaagccuuggucccucccugagcuaucaagccaguccauuaguuuuauauaaucagauuccuauaaucuccccuugcauugaacauuucuguaauuccagaaaacucccuuaagccuccccucccuuagaagcaaauaaugaucugguuucaggaccaaguaccaauguugucucuccuugaguuuuguauaaaugaaaguauagucuguagucucguucacgucuggcgucuucagcagaggggcauacuucugggguguuuucucaucagucuuuggauucuuugaacaagcccagugcuuuuccagggcaccuuggagccuccacugaggacguuuuuaaugauuguggagcaucucuagaaugcuauggcaauaagacagcccauaugaucaugacucagagguguaguuuuuuuaagucuuuccuucccuccugcaggggugugccuccuuagaggcccugccuucucggugagccugcugauccagugugaugacgcuuucuccugcguggcccugcguuuccagaguccucugugcuauuccucuacucuggacucucagauuuauuuacuuguucauucauuguuuuccaguuuuccauucuguugaaaauaucuugucuucaguugaguuucacccaaaucuuucaaacgaguuaguuuuacuuuuucuaccuuucugguuacuggguacacauuaagacuuugcacuuggagcuauuugcuuaugagccucuuccugccauuuagagcucaacuacccucugucagguguguaggccuggggcacacgggugcauagagagcaggaaaagaauagauuuuguagccuaagauggagacaaggaaggugaucuucucccuguagugugcaaacguuugaaggguucugugcacaaacauuuccuaugaacugccuuaaaagguaauaauucugucuuucagaauaccguauaauaauggugauguguaacucuguugugggugcuagguuucaccaugacagcgguucaccagagaaucuugaaugucagucuuugcaaguaguuuacuguuacauuucauggucaacauccaaagcaagcuuuugaaacugagaaagccguugugguucuuucugcagucagguugaaauaaaaguguuguauggaggccucuuacuguaaucuuugagacuucuguuguccuuaaaauuacacuucuauauaaagagaaagauuugguuguugugguguuggggaucaaacccaaggcauuguacauauuguacgugguagacaaauccucuacauugagccauaccucuagccccaaggaaauaaaugugaacccagcaaccaugggaaggauagaaaaaguaacauuaacuuguuugaaaguuggguaacacucagauaagauauuguguguguguguguguguguguguguguguguguguguguauguguucucaagaagguagagcuaacucacacagcuuuuuauuaaggagccccaguuguuuauuucauugaaccaaaugagauuuuuaucccuugauacacuaaacauuguuaaaaaucuuuaggauaaauauguaaaagcuuuauuacuuuccccuccguauauagaaauucauagguuuuggggacauucucuggguucuguucauuccuaaacagagcaauauucagguauacuguaguuuauauuguauaaaagagaagaaauugagacucaaggccuagugugauuuccugcugcuaaccugcucaggagccaaaguguuuggauaagaagccaaagcagccaggauaccacauuugucagcccggaaagaaagugcuugguguaacuuuguaaaccagugcaaaaucauuugacuccacuguaagcaugcauugaccacuaacagcuuguugggacccuucuccaauugaagcagggaagacaacuuauacuauugcuaagucugaauaucuucuuaacuacuuaaaaaucaaguugucaacagcagaauaugagccaccucaucagcgcuuacccagugaacccuacguagacuggcucacaucuugugaaacgugugaaugugugcaccacccagcucugguguaacaagccugugucuaaagauauuuagacauucuguauaacuaauuucaagccugccugccugccucccucccucccucucuccuucccucccucccucccugucucccucccuuccucccucccucucucccucccucccuuccuauagaaucuaaugagauagcauaaggaaacccuaccuagagcucuuuaacuaggugagauguuugaagggcuaguugauagcuaccucagacuugggccauucucuuguuaucugugucuuuccuaaauuuggacuuuggcuggcuccacugauauccaaaagcccaugcucuuuugcccacagauaagcaaaauacugccaacagcacccugcuaugagagcccaugagauuucuuucuuguccuggucucuugcuaacucuaaauuuccaaauguuccucaccccaggucacuuguccagaacacagauucacaaacgucacggugagaugagacagauuuccuguucucacacccaccaauuccaacucauucaaguuugggauggaguccagaaaucuaauaucauccaggugauuuggacaccagagcaccugagacuacacccagacaccgcacuaucuagaguguuccuuaugugugaaaaagugugugugucuauuagcacacuaacgauaaauagcuccaagaguccauuccuauaugucgaaagucuaugcacuucugaggucuuguacgagcacuuuuugauucuucugcccuaaaagcaacugaucuggauggaaggcggcaugacggaauaguuaauaccugacugggguucacuguauuguuuugauugaagaaaccugguacuuuacacagggacucguauuucucaggcuugagucuuagaacacaccgacaguuauugagccacacuucugucucugacccaccuucauugcuagauuuuucccccccacguauguguggagugugcacugugagcagcuuucugcagccugacacaggcuagggcauaagauggaaaccgcacccuggaagcccagcuggccaccucugucuggaagguggaagacaggccaauggggccagauuacaaacuaccugaucaacacaggaaagagagaggaaccggggaagcauuguucuccacuuaucuuucagucucugcggcuccagaggagacaugagcuagagcauucuuuggugcacacuggccaccugaacugacuccgcccuuuggauccugaaucacggaaguagccagugagauccaguaccgaguuccacgccuggaacacggggccuucaagggucaugauugauucaggucugcccucccaguuccauuugguuaaaugagacuuaggguggcuggcaccuacuugucagcucagagcccugcaugaaaaucugaacccaagagccucucgcaaggucugcagccagugugacagguagcgugguauuguuuaugguaaaguggauucaaugguaccgacgguuuuguacaaagucgguuccccaaagguuuacaauuggugggagauuuugaaauuguucauauagacugacucaagggcgucgugcauaagaacaaagucacuaacugcugauuuuugaaauuuagaggagacccuugucuaccacgugucucccagguuacuuggcucugaaagguuaccuuuaaagaaacaaacucugaaggucgugaugcuaggcgaccaccuuccugcaugcugccuccgcccuuuggcacucucaaggccccuccugccccgucuuucuguaccgucuauaacaacuccaaauuugccguuaucugucaucccuaacugagaggccagcagaacacagagcuguuuccucacucugcaaaucaggacuuagagguccagaaagucagaaaugccuuuuggucagacagucugggcccuaccuuucuggguuaguuuucucauggacaccuuugaucuuuuaaaaaaacagauuagauuuuaccugaaaguguaucaugauaagaucuuguggaguaauguuauagaguaaucaugggggaagggcccuguccuaugguaugguucuggagcuggggaccaggagaagugagagaaaguucuuaauaagguacugaagaaaggcaugaaaaguacaagcaggugacugguuccacguggccagagagagagacugggaaggagaaccaagucgguaaggcaagguggacgcaauggcuccccccauuuuccucauaugugaaguggaggggagcuccgaaggcuucccacagacagcuggcuucccagaacccuaucagcagagucacaugauuacagaaguccucccguuuuccaguuugucaccgucucuuacaaggcaccaaaugugccucacuuuccauuugaccucgccucucccacgaucccuugucauucuugauugcguuuuaggucuguuuauagaacacaggcagaucuccaggaagcuggggaaguucuguugucuagaauauaaaaguacaguagcuguaguagauuuagaagaggagacuccagaagcacccuacuguguguguguguguguguguguauguacagguauuauauagggaagguaggugcuggaguucaaacucaauaaccauuaguuuguuuggaccuucuagcaugucuccaagaaaacuacagucagguuugauuccucuagaauaacaacaguaacacauaucacacauuuaaauggucaagcacagggcgaggcgcuucccccuccuaaucauuaauaaucauuaauucaauagggcaagcaccaguguggccucuauuuucgagaugaggaaaugcaagcacugacugcuagccaucccccugcgaagccugcuauucacauacuagaagaaggcagcucuguaucacuuccaagaacauugacauuuuucagaccaugggugugcuauguuuucuuccauaacagaacacucauuagucagcgagcaaagggaaauuuaucucugugagauggaaacaaccaguccaaccauucccccaccuuacaaaaaaaaaaaaaaaaaagccacucuggggacuaauuaaguaauggcuucucuuccucuccauuccuaacugccaaagggccugagaguaauaggauuguguuuucccaaggucagauugggcuguauaguggagccuuuucuagacgucauccaagugauuguuugggaaacaacaccagccuucccuuacuucuuaugcaguggcuuuuccuugcucaaauagcugugauuuagacagggcaaggcuuccugguuuucccgcucuggccuuggccugauagucucggggccagugcaucucucucuacuaucuuuaacaugacuuagaacuuuagacauaguuuuguaaaugagucuaugucuauguacuugugcaugcuacauauguugucuaccacucagcuacaucugcagcccaugguuuugggagaagagacaccuguugugcggcucacacuagcuuuguacucccauuuagcccaggcugguguugaacucucucuccuccugccccagaucccugaauaucaggauauuguguguccacugucaugucuaaccauacuucuuuucccuucuuuuucacaaggucucacucuguagcucuggucguccugaaacucacuguaucgugaggcuggccucacuguaacuuaaacucacaaagaccugccugucucugcugcccacgugcugggauuaaaggugugcaccacuaugccagguucuggcuguauuaaacuagauugcuggaacuagcuuuucaagcuugaaaguauuuuaugugugcuuaaucaugcacaagcuuuuaaacucgacuaauggggugcuuaaaaacaaaggcuuaugccgagaguagcagugcacgccuuuaaucccaguguucugggaugggagugggugggugggugggugggguucucugugaguuuaaggaaagccagagcuacacggugagaacuugucuugggaguuggggugaguuuuucuauacauguuguaacuucuauaagccaacuauaccucgaagcaugggguacuccacagucacucacucauucuuaguccuggaugaccuguuuuucuuuuggcuuugcugguugucagaugaagcgaccgauagcaguggacuugaggcaaagaagcaagaaggcaaaggauaggcagaagccagcacagguggcccugcaaccucuccaugcuaugagaagccaaaaauaaaucuauagccuaaaauugaggggugaaguccuuauucccccaccacacacauguaugucccgucagacaggaagcacccugagagcccuuaauacacuguuuacauucucagaaagaagucaggggucucucuaccaaaucacagccuccuuacgagcccaggccgguugauccaaacuaaagccauuugugagggugagacgcguagcccagcuguuguguacagcacuguaaacagcagaaggucccuugcacagcugcaggcugaugucaccuucuggagccuggccuggccuggccuuugguuguuggaaguaacaacaguaggccauccgaucccccaucugucucccuuucucuuuuccgguacccccuucccaucuacacccccacccccuucacugagcuuacaguagccagccaagcugcacacuguuugggcuacuggguuuuguguguauaaacaaagcaaacagcccuauccagugguuaauggagaggaucucuguguaucccacuugauuuuaaacauugaugcacuguaauuaacauaaucaaacugacaauaguuugauuaugagcagauguguaaaagucuggcagguguagccugcacuuagaagcccuuugugcccacaguagaugcugacugucucuuuucguuuauccugaguggcagguuugccaagaugccuguauaccaggggccucuguauaaggugcuuccguguggagauguuugugucuagcguggguuucuggaugagcucggucaugcuugcuugcuuguuaucugcugacguguaaaauucuaaaacuagcauuucccucucuagaaacggauccccuccucaucgauuggcuacaaagcauuuuuauagacuuugcccacagaaaggucuaacuugggauacacaggggaccuaaugggaagauguccauuguucuccuauuuauagguuggaaagucaguuggcaaaagcuaauauuguuugcuacuuagaguaccacuggaugucuuaaaucuuuuuucuuauaagcaguguaaggauguuuguuaguaauuaaggccuuucauuauguuuuacuaaauucuuugaaagaaagaaaaaaaguguaguauuuaaucccaaaugucuucugggauguccccugucauuuggcuuucaccugccauuuuggcucuuuccuccaacauuccugcuuugugaacugguuuguuuaugacuuuugucugucuguucaugguaggcuuuguuugucuugcuauguaucccaggauagacucaaaugcaaagauccuccugcuucagccucuacauuacuaggaauaaggcaugcagagcacacaccacagaacuuggcucuucuuuguggauuguuuuaguagucaaggaacacuauauacuguuagguauggaucaugugggaauaaaaauuucagccuucauacuacaauuuuauuaauguauuugugacucuacuuaaaaauccauugcucaaaccaaaauuauaauguaucuccccaugugcauuaagauuaauacaacuucaucauuuucccccugccuuuuccccccuccaacccuuacuacauaccccuccuuguguuguggguuuuguguuuguuuguuuguuuguuuuuuaaucauguuuuggugaggauguggagaaauugaaucuugccuauuacauuguaaaaccauuuuaacugaaagcggaauugcuauaugaaacagcaguuccucuuuuagauaagcaagaaaguugaaagcagggucacggagcacuuggguucccauggucuuagcagcauuguuccagguggacccgugguagaaguagcacgugccaucugugggucaguacaugauguguacggucaguggagucauagucagccugaaagggaggccagucucagcacaagccacagugcagagggacacugaggacaucauucuaaguggaagaaggaugcuuaccgaggugggagauaauggcagcaacagucaaaaugcaguguguguguauaugugugugugugugugagagagagagagagagagagagagagggagagagggagagagagagagagagaauuacagagaaugacaaagagaaaggauuuaucaagauaaacuguggcucaccauuuuggaggucucaggccaggaucuguugaccccgcuccuuugugcccaggugcaugucguguuagggcaagcacaugguugagaaaacaauguuuuuccucacguuaaagugaggaagggaaagauagcaucauggucucccucucggagguguguaccagugaccuaagguccaccaccauccuuuggcccugggagccuccuuugauggacguuucuuacuugaacugcagugcuggugaaacagugccauguguaugccuccagagucaucccagcgguguguaaauguggugugucucccgacaccugagcaaauguaaaaggcccucuccucuucuuucugcccauuucaguugcugcuucaagcgccugugagaagcuagaaaaggcuaggacugacuuacagacagcguaucaagaauuuguccagaaacuaaaccagcagcaucagacagaccggacggaacuggagaaccggcugaaggacuuauacaccgcagagugugagaagcuucagagcauuuacauugaggaggcagaaaaauauaaaacucaacugcaagagcaggucugugcggcugggcugcuccggcguggcugucugcugccguucuagaugcugucuacauucuucauaaguuaucccuugccuuuuuaguuuagcuggagaaagcuuuggggauugauggcuuucucuuaggaugaagcaguguugaguuaaagaagcgggaaguagccaggcacagugggacacacccagcaccccaacucucagaaaguugaagcagaaggaucgugguugagcccugccuuggcugcagagagagcucaaggccagcacagggaacuuuaagucccuggcucggaaguaacaacugccaacaggaccacauauguucucagugacacagaggccuguuagucucugaauucauccccagugcaggcaggcaggcagacagacagauagacagguaaaaaacaagcucugugaucccaccagcucuaguuacuuaggguuuuacugcuguaaacagauacugugaccaaggaaagucuucuaaggacagcauuuaacuggggccggcuuccagguucagagguucaguccauuaucaucaaggugggagcauggcagcguccaggcaggcguggugcaggagcagcugaagguuuuacuacuucaucugaaagcugcuaggagaagacugacuuccaggcagcuaggacaagagccuuaaaccuacuccaacgaggccacacccacuccaacaaggccacaccuccuaauagugccacacccccuggcccccauaucccugaccaccaucgcagaggcugagacaacuuuauaagauugucucaaaauaaaagcaaaggagguucagagcuauagcuuagaggugcagcaagagguugcaaaggauguccacagcucuggucaaucccuaggaguuugauaacaaguuuuuaauagaagggauaggaauaaccccaaacaauccacuuggaagcaucccaguguuuggcuucuaaaccauuggucuguacuuuguuuuuagaugccuuuucaauaaccacuuuucccauuaguaucauaaacuuggaauuucccuguuuccuauuuccuuuauuuuuaaguuuaguaucuucauagucucuacuacauguauauauauguauauguauauaugugugugucacacacacacgccagacacguacugggggcuaagaguagaguggucagugcuacagguguggggcugagguggaccugugaaguguagcccuacuccuugagguggacuugagugcuugggcuaucuuuguuccuggggagaauggguuugaguugugggagggggggcagggccagaguggguuguucuacacauguguuagguggcugcaacggaugacggaggucccuaguguaugcuccuucaucugacuuagcacuuuucuucuugcuagagaauaaucauucuguuuguuccuuacaguuugacaacuuaaacgccgcccaugagaccacuaagcuugagauugaagcuagccacucggagaagguggaauugcugaagaagaccuaugaaaccucccuuucaggcaagggugcuucuccugcuucaggagacaggcaguggaaacgcgugguauuuacuauaacgaaacugacucaugauucucccuugcacagaacacccuacagcauucacuuggcagaccucuugguuucuuugugcauuguucauugucaguggaugcccuuuucccuuaaggaugcaaauuauaguugguuauucgugccaggccuuuaggaaacagggugaacuuccaaagauucuaaaaaccucucugguggugguugugguuggcggcgguugcuacuuuaggucccgggaaaggcaaggugucagcuucuagcucagugcugcacggaauccacacguacgcauucuugcauucaugacugugguagagcacaggugggauuugacggacaaggacaggauaugcuguugugauuucaccagcacuggaaagcuugaugucaaaaggaaggaacagggagaaaccuccuugucuucuuugaggacaaagccagcaaugcaauauaggguguucaccacaagucagcuguggcuuacauaguagcagggggauguguggcuaaaauggcuaugaccuuugggagaaacuucucaugagauuacacuguggggagucagagaugauggcuggcuuauacacaauaaguauugucgucuuccuacugggagagggcuuaauuuuagauuucuguuuucuucuggaagagcaaauuucuucuaggaagaccgggccccuaauaaggaaucagaaaccugacuuuugaggcccuacccuucguuuugagauuuugaagguuuccuuggccucugugggcaucaggguuucuggucauuguaccauaaaucucuggccugccucauaaagcuauucugaggagaugccgcuuaauuuaaagaauugcaucucaugaauggaaaguaucauaagucauacuucaucagcacccgagucuauauacuccagguuggagaguagugaucucauaggguuguauuaccuuaaaagaaaaaaacccacaacaaaaccccugccuuccagaaaucaagaagagccaugagauggagaagaagucacuggaggaucugcuuaaugagaagcaggaaucgcuggaggugaguggcucgcuccuggcccccgcagccgccuuggacgaggccucuguauguaugccuccgguccuuuccuggcaucugacgcuccacguguuacuguuuguguuuuagaaacaaaucaaugaucugaagagugaaaacgaugcuuuaaacgaaagguugaaaucagaggagcaaaagcaacugucaagagagaaggcgaauucaguaaguuguguauuccggcugcugcuggguuucccuccugcuugcgugguucgguugaauuuccaucagaccaggagugggcuguggagauacuccacaguggugguaucacacuguccauuugggagagugaauguguucugugguaguguugccauggcgaagccaagguaaccaugaggagagcccagaggcucaggacauuaucgcucugugucauuucccagagcccugcauaugacacugucuuugcuuguguuucuccucagauacugacuuugcuuagagaaaacuacuguuuccuuuucucccuccagauacuaguuuagagcuggagaaagcucucucuccugagcucuguuuuuauguuguaagcaaugguuucuuguuccuaauaagagauccgaugaaaguaucuaccauacuaaauaacuggggaaagauaaauuuguuuucaauacugugaccaaagucuuugagauuagaagguucuuaauucuuuuuuacuucuuugacaaugauguaagaaguuaagcuaggcauggugacucaucuuucuaauucuggcacuugggaaccugagacaauagaauaaccacaaauucaaggccagauugagccgaaugagucccuggucagccugaugauagcaugaaaccuuguaugaaaaaaagacaaaagaaaaaaaaaaaagaaaacuuacuuacauuuagcuggccaugucaggggaugccuauaaucccagcaauaugggaagcugaggcaggagaacuacuauaaauaucaagacagucaaagcaugacccuguguuuaagacaaacaaacaaucaaagggaguaaguaauuuauugcuuguuucucuaagacuaaucagagaaaucaguacaucaagagguuagacuguauaauaugugauuaaagucagagcaguuaucuuagugguuguuuuugguuuuguuuuguuuuuucagaaaaacccucaggucauguaucuggagcaagaacuagaaagccugaaggcuguguuagagaucaagaaugagaagcugcaccagcaggacaugaagcuaaugaagauggaaaagcugguaugucuccugcaggaugggagugagcgccuaccgcacaugugccuccugcgcaugugcuguuugcauagcugugcguacggaguugccugugaaauagaauagcagagcuuagagaagcuauauagcagagcuaacuuguacucgaugauauuuggaaaguacacaaagggucagaguugcacuuuccuuuccagauuaguugcugcuuccuagaacauuuauuuauuuauuuauuuauuuauuuauuuauuuauuuauuuauuuauagagugcaugcaaagcagcaucuaguuuuggaaaaauuauaacaaaucagguucccauuucaguagucugugggucuucacuugccuaaugagaaaaauuacucuaaaaccaguauguuaaugcagcacccauucuagacagaaggacaguuggaucuauccaguaacuucacugguaccacacaaucuauuagcauucuguaucuuuuuaagaaugugacuaugaugaaaagaauuguguguugaucagcccaguuggaaaacagcaagcauuaaucagaauuuaaaccuacuccaggcuguguuugaggggugugcccggugugcacugucagccuugguccagcccugaaacucaggaucugcuggccaggacaugaaccaagauggaaggauuucucagcagcuuaaguggcccuagcuguugcuugcuguacuuugcucccaacugccagccauccagggcugcaugugucuccuccacccaguugugggugacucgcuacgccuugaagaaaagucucauucaaaguuaaacuagccuugaacaauagggagcauagagguuacucuuuaucuguucggcuuuucugguuugggggauuuggcuuaguuugguguuuugauuccuagagauaauuaacugcuuuuugagggaggcagugcuuaagggaacacacaggcauuacuucacuucaucaggaaauguggaagugggggaagaggacuccuuuuuuuuauacgcugcggaguuuggaucugccauaaugaagaaugaaauuaugucauuugcagcaguaauuggaggcagagauuauccuauuaagugaagaaagcccggcccagaaagacaaauaucauuuucucucguguguggaacugagaugauaaucgugcauacacugcagucuagucuagucuguugacaaacacaugaaggcgagggcucgcuggaguugauuugagugcagucacaguaaagacccccagaugacagugacaugaguguaggccagacauguuucuaggaauagaaccagccugaguucauccucauggcuuuuggucaucaugauuccgcuggguugguucaugauugcuuucuugcccaccaagaugcauaucgucuccuaagcuacuaaggaauuucucccaacuggcauuuuaaguccagcccaguuccaguuugagagaauacaucccaucugucaagugggugucacaaugauaguagauacauacagcugggacuccucaaucuacccaucuuggaggugccaggaguacaggaaguggauuuuuuuuuuaaacgaaugccugaaacuccuaguuguuaauaggcccaaccuaguacacacagcacuucuuggcaaaggucagccugcgccaccugcucagcaggcuggcaaugaugacucaggaaacccuguuaacaauguguugcuccaucucccguucagguaccuaaacuuaucagacaaucucaagugauacaaggcccugcuguaaaaguacaaacacauuuuaauuucuauugagucaugauaguucuguucugugccccgacugaacagugccaguuggcaucgcccuguuguuuuuacaggaauguagguugcuaagacgauggguacacuuguugccacugcuguguuguauacuuggcagcaccaggucuuuagagaagauagaacacuuaguguauuaggguucucuaaaggaacagagcugauacacugaucuauuaaaggaagauuugcuagacuggcuuccaugaugagcuuagacuaacuaguccagccguggcugcccacaagauugggcgccucugcaguuccgaucugguaccaaaggccagugggacuucugaagagccuuuugaucaccaguccacucuggaagcccugaagaagcugauucuaauaucagagacagaaucgucugcaguggcaacagggcacguagccuccccagugagaauaagggccaagcaagcaaagcgcagagucaaaagugccuuucgucugccuccucacggcugagucacuacuagguggugcuguucacauuuagacaaggggaucccccggaggcaugcccacagccagccugauauauagagucuuucauugguuuucuucucggguaauucuaagguggugucaaguuggcagauuaaccaucacacuuagcaugaggaaacuauccaaggaagacagguuugcuuugagagcuagcucugccagugggaagcucugugacaucaaagauggaguuuugaccucaguagagcaaagcuuugauagaauaaugguuugaggccaauugucauguuuuuguuuuuuuauuccaaguuuucccagguugugucuuaccuugaaaagcauuucaagguguuucuccccugcccaacucccccaccccucuuuuuuuucauccuguagauuuuuuuuuuuuuuuagaaaguuauuucaucugaauggcaugucaugaggauuuucuggacucaaggaugucuuaaaaacaagaauuucaccugggugcuguaauccaaacagaugcgccauagccagcugccaugacagggacuuggggguucauuuuugaccucauguuaaguucacucugagcuuugauguugccucuuaaagaagcaauaaaccauuccuuacggaagggagccaggaugggaucagugggucaccauguucagugacuuuaaaugccuauaaccacucaacugaucaguuuguguaaggcuggaaagagcacaagugucccuuggccugaacugagcagggaagccugcuuucuucaguuacuucuuuaccuaaccuugcuacauuguaucuccauagggccaccuggagguaaaugccaaaaccauccuggaauaaguuuaaggcuuuccucaguauggccaagaccuauaggcucccucccuuccucuucuccuuccuuccucugucuaguuucuuuuuuccuuccucccucucacccucccucugucccuaacucucccccuuccuccuccuccucuccccgcuuccuucuuugcguauguguacacgagugcuguagauacagggguugugugaacggagacaguuaaacugcaguguuuccuuuacugccuugaggaagagacccagcacccauggucaccuaggcaggacaccagcucccagcaggacaucucugaaagugucaccuagaauaaaaacauuacugccuagcucucuuauuucuguguuugaugaacacauguccucaccguggucgguguaugaagacaucagugugccacuauggcuccuccugaucaacuuguugauggugccguguauugggaauaugcuuaagaagugagagaguuuauuuauucauuucuuauauauauauauauaacuacaaaccuuguuuuauacuaagguggacaauaacacagcauugguugacaagcugaagcgauuccagcaggaaaacgaggaguuaaaagcucgcauggacaaacacauggcaauuucaagguaaaccuacaagagucuauuuccccuuuccucauccucggacaucuacggucccuucuggcuacgcuccaccaggcaccucccaggcaugugagagaagcaggagaaugguucaugcauuuaccaaggugcccuagaccucucaccuaacugcagcucacuaacuguaauggcgcugucagacaagggguaacaacacacgugaacagaaagaggccuugaguuaagacagaaauaaaacaagccuugugcaagugccccauugccuacugggaaaucucccaaagacuagaguugccagcaauuacucaggauuauuuauuugggucaggcuugaggcucugguauucgggaguuuugcuuuccuuuuugugguccacagaccuugagccagggggccucacacacauuaggcaaguccucuaacacucaucuauaugcuuccuuauuuguaguaguuggguuucucagcuuaaaaaaaaaucuaugacccauaugccaguggugacacaugccuuuugucccagcacucuggacugcuucaaacagguuaaguuaaaggccagccuggucaucagagugaguuccaggacagccagagcuacacagagaaacccugucacaaacaaacaaacaaacaaacaaccaaaccaaaaaaccccaaccaggaacccuauguuugguugauaguccugggaggccuguccuuuucugaagagaagugggaggagaggagggaggggaaaucguggugaggaugagcuauaugagagaaaaaucagaaaaaaaaaauugaugacccuggacaagaaccuguguauucccccagaagaaguuucuugaaccuucagauauaaacaguaguaguuccuuuuugacuuggauucauaugcucucuggguuuuguuuuccaggcaacuuuccaccgagcaggccgcgcugcaggagucccuugagaaggagucgaaggucaacaagagacuguccauggagaacgaggaacuucuguggaaacugcacaacggagaccugugcagccccaagagaucccccaccuccucggccaucccuuuccagucccccaggaauucugguuccuucuccagccccagcaucucacccagaugacggcuucugaacgcaggagacucucugaaggcacugaggugcgcuucugcgggacugacccgaaguucagaguucaugggaacucgaguugcugcguuagcucucuggaauauccccaggauaucgggagagcagccgccaaccguuucagcuacguacgaauagagagcuccaauaggagacuuuuaacuugguccaaaagccuccuccaaaaacagauuucggaacugaaguggacauaguugcacaaagcacuuacggaacgagggaaccuuguucuuugccuuccuucaccuaagcauaggggaaaacucucagggcccuauuaagauaaagauuuauaaccuuuauaauguucuucaccagagacaccuucuugugauuuuuauuucagucugacugugggcaaggggggugugugugugagugaaauggguguacuggcgugucacgugacugucauagccccgcccccugcuguguauuaaaagucaacagcuguauauagcuuggccuguauuaaccaagucauaaucggcacacgagcgucaacaaaagccauagaagagaaagcaauagugcuugaauuuccccccaacucaucucagcacugugccacggcagggcucgggcaagacaggaaaagccuuugguuucuugaugacuguacauuuauuucucuguuguuaguuuuuccauguucggcauuauccguugauagcaguuuuuuuuucccccuguagauuuucacgagccuaauugcuauacucugauucauuuucucaggcuaugagcaaauguaguucccuaauuuuucuaaauacaaaucuguauaaagaguaagggggcaguaccaauggauguuucugguuuauuuuuuucccuugaacccaagcuagcuucauagcgcuaauccuccgucuacccuccuguuguucuaaccuccgccuugccuucuccuccauguagagccacggaagcaaagcgcccuccuuccuacccacagagugugcuuuuccagggccaguuuaucuuggaggugcugaaccuguuucccaaauaagcuaagcucugguucugacacuacacaauuuuagaaaccccgggggggaaaccaguaaaggcauuuuagcauguacuaauccacaugagcacagaguuaagccaacaguucuguguugaguagauccaagagcgggaaugcugacuugggccccucugagcauucuuccagccacuggaauggaacagaguggccaaagagugagagguauggcuucugcagcuccuucacacugcauucaaaauucagaucuucgcuuaccaucucccuaggcuccaaggcucugugaaaguuagaaggauagcuguggcuccccaccacccaacccacaaacuucccugugcaugccggcauugcgaugucaguauuuacuaauucauggucaaugcugcucagauaaccccuauagcgaggacagauucaggauacuagaggugagucauccuagacuucugcacuacagagcuaacugauagucaugaugcaugcuuuuuauuagggguuguguuugaagucucuuaucuccaauaguuuaugauguauguaaccuaccauguuugcucccgauaaauaggaaugauugcagcuucacugccaccuccuggaauagcucugcuccuggucccaaguuguucucaaugauguuagccaaagucagguuugucauuuaugcccuaguuaugguaaagcucaaguguugaccugccaucccucauaccacguagaugucugggaagucaaaucuuacagcaauuaaaaugccuagagagcauuuaaggguuuuuuuguuuuguuuuuuaaaccaaacauuuuauguacaauacaaaauuguugacacaucguuuaaaaaaaaugugggugugugaacaacuguaguuuauagcaaugggaaaguguauuuuacuuugaucaaauaaauaaugcuggaauauucaauguaagaauggcagccucugacauacuuacucuucaaagcguuaaguuauaugcucccccuucucaucccuccuuaguuaaggcagccaggcgcccuaugcuauuauacagaacuuagaacccaaugccaaaauuuguuguggcugaaauuggcucacagagcuugaguuuaagauuaagcuuuucaaauucaaaauacaugugucagagaacgaaacuuuggcuaguuugaaugauucuucugcaaggcgaaaagaaaauuggaacagcuguggucuuaaguguuuuuucaagaccggucuuagccaaagcugaaucuucuucaguccauucaucuauguuauauuaaaggcuaagguguuaauaguguacaugcaguuauuuuugaauagagggguuuaaaucaguacucugaguguggcgauuucaauguaaaaagaugugauuuugauaccuuuauaaaugaacuugugcuagcuuugauaaagugacauaucuaagcauuugaau

SEQ ID NO: 12419 - RNA, 102051 nt, Mus musculus
uuaaaaaauggggagacacuugaccuugcuucugcuucugcuccucuuccuccagcaguuuggagacagugauggcagccaaagacuugaacccaccccuccuauccaguuuacacacuuccaguacaaugucacugugcacgagaacucggcagcgaagaccuauguuggccaccccagaaagaugggcaucuacaucuuagaccccucgugggagauaagguacaaaaucgucucaggagacagcgaaaaccuguucaaagcggaagaguauguucucggagacuucugcuuucuaaggauaagaaccaaaggagggaauaccgccauccugaacagagaagugagagaccauuacacgcugaucgucaaggcaguggagaaagccaccgaugcugaggcccgagcgaagguucggguacaagugcuggauacaaacgacuuaaggcccuuauucucccccaccuccuacagcgucucuuugccggaaaacacagccauaaggaccagcaucgcaagagucagugccacggaugcggacauugggaccaauggcgaauuuuacuacaguuuuaaagacagaacugacguguuugcuauccacccgaccagcggcgucguuguuuugacuggcaggcuugauuuccuagagacccagcucuaugagcuggagauucuggcugcggaccgggggaugaagcuguacgguagcaguggggucagcagccuggccaagcugacaguucacguggagcaggccaacgagugcgcgcccaucauaaccgcggugacguugucgcccucugagcuggacaaggacccaaccuacgccaucaucaccguggaggacugugaucagggugccaacggggagauagcgucuuugagcaucguggcuggcgaccuccuucagcaguuuaaaacagugaggucuuucccagggaguaaagcauucaaagugaaagccgucggggccgucgacugggacagccauccuuacggcuacaaccugacauugcaggcuaaagacaaagggacuccuccccaguuuucccccgugaaaguuguucacaucauuucuccacaguucagagcuggcccugucaaguuugaaauggauguuuacagagccgagaucagugaguuugccccuccacauacacccgugguccuggucaaagccauuccuaguuauucccauuugagguauguuuuuaaaagcgcuccuggaaaaccuaaauucgguuugaaucacaacacgggucucauuuccauuuuagaacccauuagaaggcagcacacaucccauuuugaacucgaggugacaacaagugacaaaagagccuccgcccgagugguggucaaaguuuuagguacaaacagcaaccccccugaguuuacacagaccucguacaaagcauccaucgaugagaacgcgccuaucggugccgcagucacgagggugagugcgauggaccccgacgagggggagaauggcuacgugacuuacaguauugcaaacuuaaaucacgugccguuugucauugaccacuucacgggaaccgugaguaccucugagaaucuggacuaugaacugaugccucgcguguacacgcugaggauccgugcgucugacuggggcuugccauaccgccgggaagucgaaguccucgccacgauuacucucaauaaccugaaugacaacacaccccuguuugagaggauaaacugugaggggaccauuccccgagaccuaggugugggggagcagauaaccaccgugucugccauugacgccgacgagcugcagcugguccgguaccagauugaagccggaaaugaguuggauuuguuuggcuuaaaccccagcuccggugugcuguccuuaaagcacucccucacggauggcuugggcgcaaagguuuccuuucacaguuugagaaucacagcgacagacggagaaaauuuugccacgccguuauacaucaaccuaacgguggcugccagucgcaagccggucaacuugcagugcgaggagaccgguguugccaaaauguuggcagagaaacuccugcaggcgaauaaguuacacagucagggggacguggaggauauuuucuuugauucuuacuccgucaauacccauacuccacaguucgggguuacucuuccaacuggaauugagguaaaggagaaccucccggugggugccaauauacucuucaugaaugcuacugaccuugacucuggcuucaauggaaagcucgucuaugcuauuucuggagggaaugaugauaguugcuuuaccaucgacauggaaacgggagugcugaaaguccugucuccacuugaccgugaaguaauggacaaauacacccugaauauuaccguguacgaccucgguauaccccagagggcugccuggcgccuucuggacgucacgguucuggaugccaaugacaaugcgcccgaguuuuuacaggagagcuauuuuguggaagugagugaagacaaggaggugaacagugaaaucauccaggucgaagccacugauaaagaucugggccccagcgggcaugugaccuacgcuauucucacagauacggagaaguuuuccaucgacagcaugaccgguguggugaaaauuauccagccuuuggaucgugaagugcaaccugugcauuaccuaaagaucgaggccagggaccaagccacagaggaaccccgguuguucuccaccgugcuccugaaggugucacuagaugacguuaaugacaacccaccuagguucaucccacccaauuacucagugaaaguucgagaagaucuaccagaaggaaccaucaucaugugguuagaagccuaugaucccgaugugggucagucaagucaggugagauacagccuccuggaucacggagaaggccacuuugauguggauaaacucagcggcgcaguuagaauuguccagcagcuggacuuugagaagaagcaacuguauaaucucaccgugagggccaaagacaaagggaagcccgugucccugucuuccacuugcuauguggaaguggaggucguugacgugaaugagaaccuacacacuccgguguucuccagcuuuguggagaaggguguagugaaagaagacgucccuacuggcucaucagucaugaccgugucagcucacgacgaagacacaggcagagacggagagauccgguauuccauuagagauggcucuggaauuggugucuucaggauagaugaagaaacaggcaagugcuguuaaucucuucugcuggcugcacuuccuccccucucuccucuucuuugcaucagaauucccaguugguuucuguuagggcuuggcauugaaguacguuuacacuuuuugcgcuaugaagcuacacacugaaggaucaaguguacauaagaugaguagaagggauaccaaucuuugaaguuuguacucuauuaucaagaucaucacugugguuuuauaguaaccuugaaaagcauucugauuaggcuguuucguggugugauguuuccguggugguacgguaacaucgacaccaguuggagugccaucuggaggguagugcauacgugcaaaguuauacaacauacccagagacuuuuaugcacuaaaacuacuuuaucaucugcucuauguccuucaggcuuugagaggccgugguaggguaguggaagguugaacugagaauaccuggcugguggcuguguauuagggucuuacugcuaugaacagacaccaugaccaaggcaacucuuauaaaggaccacauuuaauuggggcuggcuuacagguucagagguucaguccauuaucaucaaggcaggaagcaugguacagaagaagcugagaguucuacaucuucaucugaaggcugcuagcagaauacugacuuccaggcagcuagaaugagggucuuauagcccacacucacaguaccacaccuacuccaacuggaccacaccuucuaauagugccauuuccugggcucagcauagacaaaccaucacaggcugccucuuucagucaggaucuucccaaaaugaauuauuuaaucuauaagauggagacauuccauuuucuuuuaauuuguuuuguuaugcuuugugguaugggggauugaaccgauaaccuucugcaugcuaggcaggcacucuauacacggauuggcugcaucaagguuuaugugaggaagucauuaaguaauaacguguuggguuuauuaauagguuuuggaaaugguguugguguuuugcuauaacauacaguuuuucuccagaauacaguucaauuccuggaaucucuguaguagccagguuuuuuguuuuuguuuuuuguuuuuuguuuuuuguuuuuuuuccagacagggugucucugcccauccuggaacucacuguguagaccaggcuggccucaaacucagauguaugccugccucccaagugcugggauuaaaggcuugccacccccuagauaagccccuacucccccaaccuccaccccucuccaguguccaguucuugaguggguacuguuuuccuuugaggacacagaucugcccuuacaagucaguguugcaauggaugugggcuuucuggggcaggcuauuuaccucugacaucuaguucuuuagagugcccagugcacagaaacugcuuaauaaacaguaacguaauaggugaauugaugaagguuuuggcuuugacugcccugcccucugagugugguaaauacagggaaauguaaugucucaacaccaguaaggucugggugggacuuaguuuacaggucuccuugauguucuuucacagaucuguguauucuaagaagaucuuuuuauuauguuaaaauuugauauguuugguaauaccggacacauaagacaagaacaaaagccugcaguauuuuagccguaagucacccuaucuuagggugcccagcaucuggaaaauaaaaccuuugccugagaacaugauucgaaggcuccaggcucacuaaaauuuugcuuucuauuaagucaaggggcuuuccccucauugauuauauuucacuagcgucacucaaauggacuucucagaauuaguuuaaggcagaggaaaauggcguaaucaauaguguuugguaauuagucuucuggagcagacacuuuuuggaggggugcccuucuguccaauagaaaucagaauuggugguccaguaucaauauugaagaauacucaggaguuaagguugaaauugauacuuuuccuguagauuuucugggaaguuauucuuaaccguuuuuuuacccccucucaacguaaauuuccaagccuauaaggagcuguuagaaguuaaaguugagucacaaaauauaauuugagccuuaauuugcauucucuucgugacuuaaauuaugagcacugccuuuuggcucugucuuuuuuuuuuuuuuuuuuugugaaaauaguuugcuuuuuaaaaaggaucacauagaaacugguauuuuucaccuauaaauguaagggaugggguuguucccgcugccaaauggggagaaggagacaggauggauagcauccugaaauagguccagagcagugugcaguggccacggacuuuuuccagugguaauuuagugggaggggaggugagggaggcaccgggauucuagggacugagauugguuaccauaugaaagacucuuacacacgucuauaauuauaguuaaaggugagaguggagcuagaauguuucuaagucauuauucugggguucuuguuuuacagagggauagucucccugggcggugguauguguauaugguuucugagauccuuuaaaugauguacuagcuagacuuugaacuguuguauugaaacaauguauguugggcgguaaaucugucugaccuaguuauuuuguagauuucuagccaggagauuggguauuaaguguuaaauuucuucaggaaaaccaugucuaauggaguagaaaugcuaagauuaagggguuagugguaaaggaaaagcguuggcuguacaagcaugaggaguugaauccuguccucaggagacagacacgguuggagcucugucccugggcagccuagccagccacguuggguucaggaagagaccuuguuuaagaauauaagaugaagggccugcaagauggcuuggaaguaagggcucucugcacaaggccuugacaaccagaguucagucccugaaacucaggguuccucgucucccuacaaggaagaugugggggugggggagguagagggagggagggagagagagagagagagagauagauagauugaggaacacacucaguggccucuacacaucugcauauacaugugauucaaguggaaccacauagauauuaacauaaauacacacagagcuaaaguuagcaagcuaauuauuucauuugacaaguauagaaguauagaaagguaccugucuaaugaagaaaaguagggacaguuugggaagagugggggaccucacagaagacagcccuaaaaugcaaggaagcuggaggugggaaugucugacgucaggugagcacuuugcucucugcccauugccacugcaccuacuuccugugccaugggugugcuugauacugugcccagugaucagggccugggcagagcugcugugccaggugcuuugucaauuugacacaaacuggagucaacugcgaagagggacccucaguugauaaaugcuuccaccugauuggccugaggucauaccugugggguuuaguuuuuuuuuuuuuuuuuuuuuuuuuuuuggaaugcugauagauaugggcaagccccgcccacuguggcuguuccaucacugggcagauggucuuggguggcgguuggguugcguaagccacgggagauaagccagcgucccaacuuccugcagugauccaagugcaaccuggaaguggaugcaacagacuccuuucucccaaguugcuucuuaaaaaaaaaaaaaaugagcgcaccagcgaaggaaacugggacaacuguuuuggcuccggagacccagaaaccgccgccuucugccucucgccuuuggcuuucagcugcucgugaagauugaguaaugugagcagguuuuugugguggcuuuaacuauuucaacaccgucagaugugcgucccuuuuuacgugcuucuuacaggucagagaacacuccagcaaccgacaucuaauucuugcucuguuugggagucuucucuuuauccaugucaauuucaaacaccuacaaaaguaguaauuaaggaaauucuacagacucccuaaaauacgugauuaaaauacacagccuuaccaguugugaguuucguauguuuugcuauaacugcugugucguuucaagguggggguggcagucgccugcccaucugacaucucucgguauguuuuucugggcagcuuuugggucccagcgacucucacagaucuggaccuaugugaucacccugccacuugaggguuugcaagggucgagcauggugugggaaagcuugucuucucugaguaccaauuuccugagcucuaauuacggcucuugaagucuccgaaggggccaagcaagugguucaauagggagagugugugccaaguagacuugaguuugcauccccgguacccaggcaaguaaauccagucagaguggugcuggccccuagguagugcaaggauggggguagagcugcagauccuucaagcucgccggcugcccagacagucuggccgaaucaacuaaccaccaaguucccugagagaccguuucaggaaaucaugaugaggaucgaggaaaagcugggccguagcucccuaguguacgaucaugugcuuauccaccagcacacaccuguguucccagacacaccacgcacgcacacacacacacacacacacacacacacacuuaaaaauauccuugcugggaauucuaaaaaggaauuaauagaaacacuuuguggugucuuuaaugcaugucugggcuggcauuuagauuugggcucauccacauuacacucagcuuuccgcuccuuugccguggcucuugguugcguuguugugagcuucgaccuguagcagaaaagagaaagagcuucccuuccauacugaacaaauugcuuaggucacuugucccccaugucuguccuugcuugaggaccacgguacuacgccauuuuccgagacuuaagugagucugcaggaaugcuuagcagugcuuguuagcuguuaauggugucgacacgcugguugagucucuuccccacagugggugggguaaucccaugccagggggcacaauuucucuucauucuggaggaguguggcucaguguuggguugguacaggaacgcgucucagaguguuccugguucuaacugcucuguugcggggaauccaugucuuucacuaagauaagagcaaauuguaagcuaauuagcgccguguuacugguaggcugucauuguguuuucagaacugaaauuuauguuuguuuccaugggaaaguuggaaugaauuaauauggaaaucuagcuguuuuaacaagagaaucaccuuauuugagauauagaagagaaagugaaggcuguauguaccuaccuaucuuccuccauuuguccguccauccauccauccauccauccaucuauccaucugaugcuuggcaaacacuguauucucagaccuuuuguuucaaguuuugguauagggucuugcuaaguggcccagguacgccuuggauuugccaucuguggugacuccugccccagcucuucuggaguagcugggacuacuggcuuccaucacuaggccuggcccaggacagacugccuuucucuuaaggguacauacaggucaugguguucuccugaugggcacauccuagucacugauucuggcauuguuccucuggagguuggccccuggccuuccucugugagguggauacuguuucuguggcggaagcagaaagaauucuuguucaagccaacaugacugcucaccucaucgagaaggagaauguucuggaagucugaauauauuaauguuauguaguuacuugucccagucugaaaaauguuguauucuaacuuuaugaaggauauugugcguaugugcguguguguacguauagaucuuguggucauuuugucuuguuccugacuggcaggucuucccuggccaugacugcuggggagcuggguggcccguggugguguggugacugcuguggugggaacaguuuccccucacuggaacugggucuaaaacaucucgaaaggaacaggaacuuaaaaagagacaagggugggaggccuguucgggagguaagaaaugugcuggugaaaggccuuuuguguuucugucuccucccuuaaguggcagcagcugcugucugccccccccccccccuuuguucuucuagcagaguugaggagaaagaaauuuacuucccagccccagugagacagaaagucaggcuguggcaggaaucaucuuugaagguaugugguugcuggguuugguugaggcaggucaggcugccuugccugcugcugcaaaggcuccugaggcaggaggauuuuuuaaagguguaagugaaaucuaauuagcaacccaggcaacucccuuguguuuugaaaggaaacaguagucgcuuuucuuugguuauuuguugugguccuuaccaagucgaugcuuuaagugcuuggugaagaucuagauaggaggagaguaguccuuacaagguuuucagaacucugcuaccuucucuuacugccauuccuucagguucaaaugaagcggcguggggcaugggagcuagaggguauaagauagccguuauccauguuagggauaacacagugagcauccgcaaaccagccugggccguguauguaguaacauccuguccccccagacaaaauagaaaacaaaacaaaacaaaaccaaacaacacagaaaaguaagcagcagccacuuucugaauccuaccaacaggaaguguuguaagcacuuuaugugaauucacuucuuaauuuuuacaaacuaccagacacuuggccugcguuucacggaagcuaacauuuauggggaaggagaguaagggauuugcccaaggccgcuuggguacaggagagcuuccuauugcuucucacuugcucguugugguacccagaggaaugcucagaggaaacccacgucaaagcccuugccugacuucuggcugucuuggaagcuugaacccuacuuuuuaggcguggacaugaacggggugggggugggguaggguucaaucuaggggcccgauuuccucagagccuuguacuguauuucagcaccaagacugacaugcgccucagccaugcuuguaaccagaagcacgugcggcagcaucccugaaaagccugccuucuggaauguugagcaugcagacuccccagccuaguggaaauggugcuuuaggucagcgcuucucagccugugcguugugacccauuugggggggucaaaugacccuuucacaggggggcuaccuaagaccauuggaaaggucaaaugacccuuucacagggucaccuacgaaaaugacagagcacagcuauuuacauuauggccuagaaggguagcaaaauuaguuaugaaguagcaacgagcauaguuuuaugguugaggguccucacaacacgaggaacugaguuaaaggccgcagcauuagggagggugaggaccaaugcuuuagguaguuacuagguuccuucaaacccacuguacccugcgggguaguugaagcuaaucucauuugugcuuccccuuugcccugaguuccuuguggucauggugcucagacauuguucuuacuagugcucuggcuucugcagcuguccccaccaccaucuggugcuuaguaagaaagccagucuaacacugugcugucaaggagcuguucuuguguucuaagaggguggaagguuuagauguuuauaauuugaugcguggccuguguguauaaagauguaaugcucagugaaucuuuggucuuuucucaucuaaccaccuucuaugauuaugaaaauagauuuuaacaccuuagauaucugcccauguugaauuuucaaccccacaaccauuaaguugcuuuuguuuugaucacggauuuuuuuuuuuuuuuuuuuagcuuggcaugcaggauuggccauguuuuuaauauuucagcuuuauguuuuguuuauuguguuauuuuugugguuauugucccgcaucuauugauuuauucuuaauaccuugcuggcuguaaauauuguguguucgccauauaagaccuagugccacgagucuuucaugacuuuguuaccaggaauaaauggacuugagaagauugccauucaaggacacaugccucugcuugugaguuggcagcucuccagcuucgcagcaaugaugcaaagcaagaaacauguaugaacauugagggcgaccucaucauuuagcuuagcuugccuugccgguuaagcuauuccuuauuugcacugaaccuguuucauggcugaugaacuaaccuauggaauggaauucuguggaaaaaaaaauguguguguguguguauauacauacauauauaugugcacacacacacacacacacacacacacacacacacacacacacauuucaaacuaggcguuaccuggcuauuuugauacccuuuuaguuggugaucacuuaucucauggccuugccacuggcgagcuucucccaccccacacccuucauccuccucaucuggauaggucacuggauaguuuaguggcugguuacuggaugcuugcauugcaucccaccuguuauaacgagccuuuaccuaggcuguggccucaauugugucauggugaucugugcguauauuuacuuagaugcuacuccuucuguuacuguaucuuuuuuauuuuuucacucaaggauacaagacgugaccccgaaccaagauuaagcgcauugauuucuggcuuugcaccuugaaauauuccuucuugauaaaacaggagugugccagaagucaguaugauuucaacugugauacaguuacagcuuucucuacugccuuuccugugcaccuccuccaucagucauggccuuccccuucacccuucugaggcccguguggccucaaguucccaguucuguggucagcggguaaugcauguaagcucgcucccugauucccugauaagagucugugugccccccucacugguucccugcauccccuuugauugaucuguggagccagcccuguccccgcacccuugcccccccccucccccaauccccuugcccugggggaggcuugcccuggcuuuccugguuuuccaucccccuguuucugggucuacuuccaccaccugauccgcuucuucccaucccacguaauucuccauucagaugcuuucuucacgagccucuuucuucauauggaucugauuguucuuuuuaugcgcuuaaaaaaagccguucuugucuuguagauugcuccauugugggaaauucuaaguccuuuccccuuggauucuuagaauuggcagucaauaguagauaaucuguuagguuggucugauaagucauuggugcuuucuuacuucccuggagcagauuuuccuuagcaccaggucuugcugcuccucugggcucaaggggaugguguucucacugaacugguaucuggcucuuccguuucugucuccuuggacccaaggacagaguccagccguaaucaucucucugcuaagcacauuggccaacacugcagcacauaauuucuggugggucaacaagcaaccgacugacauaauaaucauaguuaugaagauugugcaaauguccuacguccccgauaccuagaucuaaaccucgggagacagcauugcucugcguguuugguugccacagaagcuuugcagcucugauaaaagauguuugaucugccuucagaggcugagcagguugaggagcgcagccugugcucaauccugggcugaggcucuauugauggaccugccauguccuuagaggccccagcuuuaaaucccucuguuccagugucccaaaguugccagucuucacagguugccauggagacugaccaagagaggaaggguaccugaugauaauaaugcucauuugaaugagcuucuuauauacaugacagggcacuuaacccaauguagcuaagcuuuuuuuuuuuuuuuuuuuuugguaagcucgugcugccuccccauugaguugugugagguacacggccacaaaaguaaacauuacaggcuauuuuuauuuaagguaagcagcucucugggcgcccauugaguccuuaggcgagccagcugaccacucuuguuccacuacuagcaugucuuucuuuauuuggguaagcugucagaaaacucacauuucaguagcaaagucaguuuucucaaagacucaaguuuccuguccacacggacuuauaaaucaagguauguaggauuuaauaaacuagguuagauuuaugaguaggccucucauuuaagacaaaaacaaaacaaaaacaaaccacgaaagugauucuucugagagguuauuguucauuaugaaagagguucaaacaccuuugggggaagaugaagucaggguaccaguggcagacaucugaucuguggcuuaaaggcagugacacucauguaacuugagucuggaguccucuuaacauuaggacacuuccgguuuauccuaguaccugacaugauagcacuuagucuaggcuccaccccacaguuaccuggcaacagccaggugugccugacucacuauaaaaggggcugcucgaucccucuucucucucuucuuacucuugcucuguccucuugcuccuuccccucccccaacucccuuuccgccucuccaugugcucauggccggccucuacucucucugcguuucucucucgucucuacuacccucuuaacuccuuuccccaugcccugaauaaacgcuauucuauauuauaccaucaugaagcuggucccucagggggagaggauaccucagcaugggcccgcagagguaccucuuccccccacaccugacuacacacccagcaaacauauuccuucucuucuuaucuuuuauaaaaagacaacauggcacacaguugauauuucuugauggccaucuuuggauaaaccaaaccaguguuguuugguguuuuucaucuugggauuuguugcucagccgaagaagaugguuaagcuguuuaaaggcgggugagcuggcccuguugaugcugaggucauuugguuauuauaggcaacagaauggaagccauuauuucagauggaaaugccuuggaaggaucuucaaaggugugguguuuucugccgggguuugaggggacggacacaaggcaggagggaugcacaugguagaaguauucccccagaaaguguuucuuuauaauacugggauaacauuauacagcugucggguguugauuagagaagugugaacacagauaauuuguauuggguuuuaauugucuguguuauugcuaccagaaagaccuaauuaauaagcaucacagcauagaguauaacacuaugauugaagagcuuugaaauuuuuuuuuaucuuaccuaaucucagcuuccucuuccuuuauggcccaccuucccucccuucuucccucccuaaacugaggccagccauugcuaccuguagcaagcuugaguacaguggcccugcgguaggcagaggacaugauuucucagcacccucucgucccuugacucucacgcucuuucugccucucauccaaaauguuccugagcccuggcugagggaguuccuauaggaguagcguuauuaugaauauaagugcugagaaggugauuuugacaacaaaacagcaauaguaggcuccccuccuggacucuacgaucgcccaagccuuugacuuuugaccagauuuacagcacccgucaugaauucccuccuauggagcgggccucagaucuaaucggaaagugauugaucgccccaccagaaccuucacgccacuauggcccccguaggcgugucuugccuggcaggucaguuuuguggcacucaggguccagcacugauuaggaccauugaugucuucucucuggguuuaucuucugcccugcguaucaccugccagagcgagagaacaaaccagcagggagggacuuuucaggucagucgcaaccugauuuuuuuuuuuuucuggguccuguaaccaaaguguguuuugucuccagcaauagggucuuagcauuuaguucuggugggcaaccaagagcaauagcuuauguuguuuuggagaccucugggguccucuccaagcaguaacuagugggaagcuaucccacacccagccccugggaguuucauuuaauaacccaugucaagccaugcagagcaccucuguucaaaucacuuuuuuaaaguuagcuuauaaaauagugggucucugugagggauuuucacacauccuuggcuuagcccguucucuuccccucugggccaaagguuuuuaaaauuuguucuacuuaugguacauuuuaauaauuauguggaugcauuuuuaaaaucugccuuguccgccuagaaggcagggucuguggaggcagaggcugcucugugucucaugccuuagagcacugccuggcccaagagcaugcaucaagccuuccuuggaugugucaaaaauugacaucaaaaugauuaucauaaaaugguaaaggcaagcaccuaaauaaacgcugcuggaaagaccuuauacauuuguucuguggcuuggcacgcucuuuuuagguaguggcuauuuucuucacuugaaaagcauucuuuugucaacgugccaagguaagaauuagaacaagaagugaguccagccacgaugcuggccucuuuggguuucuauuucccccucuguagaaacggcuucauuugucauacugcauucuaaagccuagaaugaagagucuccgauucugaggcuccucucccggucucugcguguuccuggggugugaacuauuucccugcaguugcagaauggugauagugugcuuuauaguccuccugaaaaauguucgaauacccaucccuuuucaugccauucauuuggccaagccuugaguucucguccgacucucuuuaggagugggagcuauauuugguuggcauuguuaaaugaguuucuuaaagcugcaguuuuaauaacggcuucuaaaguucacagagcaccuuuaaagcugucugcauugagcugagcacaugcagagauauaauuuuugauaagccagggcuggcaagaugggugaccagguaaagcuacuuguucaguccuggaagccauuucaguguugcaggagaggacugacugacuccugugcagaauucuccucuggcuuccacacaagcgcccucugacccacaugguggacacagauacaccauaauaaucugaaugguucuguuggugggggccauuaacuuagaagcaaacuccuuaaaagcccgguugaauaaugggagguaauuaagugaccagagccccccccccccgccccccauuucuuuggaguacuggggacugagaacagagccuugccugugugcuuggcaaguguucucccgaugagcuguaucccuagccuucuuuuuacauuuuguguuuugagacagaucucaccaguuuucucagucuggccuuggacucauucaguaguucaggcagccuagagucugcaaaccucucuccacauucuccuguguagcugggguuauaaacccauaccccauuccugguugccaaacuguuuuaaggaccauaauauguacgaaacuaaaaacgguuccaggaaauacauuaaaacacccuauuuuagugacuguaucugaacaaacuuuuuuguuguuguugguuuuuuuuuuuguuuuuuuguuuuuuugagacaggguuucucuguguagcccuggcuguccuggaacucacuuuguagacuaggcuggccucgaacucagaaauccaccugccucugccucccgagugcugggauuaaaggcgugugccaccacacccggcacaaacuuuuaaucuuuugucugccuucuugcuauuugggccuccacuucuaaacuuuuaaccuguacgagcauaaaauuagaaguauccuugggaagauugaaggacaggagcccuuucuuccucaucaucuguguggaauccuuuucagaagagacagaugcaucagaguguuagaaagguugagcagcguaggaagcagagucuagauuauguggaagacccacauggaguaggggaagggaaacccagagccugggcggagcuaucugucacaauuugugcagcaucuguggguguuuucuuugcuagguucuucugggcuuagcugcaguacagcuuguagcuaggcuucugguguuggcuugauauaguguguucucagcgcgggcugucauguucacgugguggccccaggaacucaaaggugcccaggcuucucuuaaggcugacgucaggaaugcuacauuguugccucucccacauucgguuggcuuguuaguaggcggauucaaaccagacuaccuaccuguuaguggguuuuaagguguuccagguuuuguguucauguuucaaucugcauagguacuuuuauccaaugugucuccucccccccacccucucuuuuauguguguggggguggggagaggaagaugguugggagagaacaaguuaaguauacugaagaaauuacaggcuuuugaaaaugguuucugaaaauaacuggugucuuaaacuucuaccuuacauagcucacuuuuuaaaaaagauaauaccaaagcauaguaccauauuaaaauacaucuucaggcuauuuuaaauauauuucuauuuaaacuaauccacacuuuugguauuucuguuuacauuucagcauaaauagaaauguauugccgggugugguggcgcacaccuuuaaucccagcacuugggaugcagaggcaggcagauuucugaguucgaggccagacuggucuacaaagugagcuccaggacagccagggcuacacagagaaacccugucuggaaaagcaaaacaaaacaaaaaagaaauguaauaaaaauaauguauuaagaaagaaauggccgggcgugguggcgcacgccuuuaaucccagcacucgggaggcagaggcaggcggauuucugaguucgaggccagcuuggucuacagagugaguuccaggacagccagggcuacacagagaaacccugucucaaaaaaaaacaaaaaaaaacaaaaaaaaaaaacaaaaaaaaaaaaagaaagaaauguguuaaagauacauuugauacauuuuaauucugcuuaguguuaggcaaaaguauaacuuagauuagacuagauauaaaugcaacagaauaugagaguguucugagaucagcugaagugagucuguuucucucaagugauugauuggacuagcuccccacgcauccagauagcauuucugucuggagaauuugagguuaggauuggggucuuuggcuacucugaccuggggaaauagacauguagccauuuugaacagaguaguguucgagugacggauucuaguuguuauguggucagagggcagcuuguggaaguugguucucucauuccacccugugggucccggggauggaaguccgguuguuggaaagugccgcacauucuucuuuucauaggauaguuuuaaguugcagugcuuuguuuaaaauaauacagccugucucaaauugacuaguccugcuugggguuccauugggccacaacacauguuaagacagaggguuuaaguacaggaugaauuugucaguuagcauuggguagcuggucauuggagucuaauguggauagcacuacagguaggucugaccaagccacucccugucuuagaguuuuacugcugugaacagacaccaugaccaaggcaacucuuauaaaggacaacacuuaauuggggcuggcuuacagguucagagguucaguccauugucaucaaggugggaauauugcagcauccaggcaggcaugguacaggaagagcugagaguucuacaucuucuucaucugaaggcugcuaguggaagacugaguucagggcagcgcuagaggguuuuaaugcccacacucacagugacacaccuacuccaacaaggccacaccuccuaauagugccacucccugggccaaguauauacaaagcaucacacucuuagauuaguuagaaucuggaacucauucucuggaugcuuccagggugucggaugauuugccuuucggucuuuuucugucuuaguuaugagcauugggaaggacgggagcagagcugguucugggaaaccaaguuuauuucucaaucaucugcaaucccuuuaaaaaaaaauugcagcgagcacuaccguguuuauucccucaccccgagucuagcuguguggcccuggcuuaacuccugcagcuagcugguaugggggcuaccugcuuaugauucagccagccgcugguuucccaugcccuuuaaguagugcauuguaauaacuaaugccauuagguauucauggagggcuucauagaggaaggggaacaugauaauuacaaaccgaggauauggcuacugaaaucugaagaaaaaaaaaacuaguagugagaaaaaaaauuacaguuuuuccucccguugcuggagguguggggugugggggcgucgggugggucauuacguuaguggguaccucuuuucuuuccauuuugccguggguauuuugcaggggacaccaccaaagccuugucaucugagcaaggccgugguggaauucccagugauggguuggugcacgcuugugagagaaguguuggcagagacaguccagugcugcugccgccuggccugaugccgucucaacaaagacguuaaaaguguuguugugcugcuguggcagaaaugccuuugucagaggugcugauggcgaaacacuggccucugacuuggcuuuaaaaccuuaacagugacgcaguucuuaaaggugacuuuuguaauuauuugacuuuggcgcugucuucuuaauggguguguguaugggagaggggaagaaacucaccgaucaguuucacaccuaaacuuuguuccuauauaaaaacuguccaguggguagcuuuuggaaaauucugagugaauaaauguccauuguauugaaacugcuccgcucaaacggguuuugggggugggguggggguggguaaaucuaacuugacuucaccugugagaccugacuucucacacaccuacauaugauggcuuaaaacagcuccuuacugagcaaucuuccaaaugauuuauuuagucugagcccaccauuuugaagugaacuugaaaaucauaagcuguuaacugggaaggucccauggguuuccaaaauuauuaacuuguaaucauuaaaccucaccuccccuucucgggaaacgagaggcguuaaugaaaaguaguugugccuccauaaaccuuuugucugugugguuucaguguuguuugcuccguucuguuaacgaggccauauuuucagggcuugugggaucuuucuguguaaacuuggggacaggcacaccugcugacuuuucuguuuauucuuacaugcucaguacuucuccugucauugcuuguaaaugaacacgggcgauuuagaucuaugucaucuuguccccgcugccccuuguaucucaaaaaaagaaagaaagaaaaucuaccuguuuccaguuaggcuugggcagguuucacaucaaaaguugugaaugaagcuuuaaguaaauauguuuauuuagugcuggcuguugaccaggaaauccacagcagcugaaaacugcuuuuuuuuuuuuuaaacucccgcagggcuaaccaucauggugacagguaaaucucuuuccucaauaaagcuucaacucccucccacuucauuucuuggggcuggugaauguaggaauugucuugcuaggaaccuauugacuagguuacugccugugcuguagagaagcggagcugccuaggggccaucccccugcaggagauuugcuaaagccccugugaaaggggccccuggggucccacuauuaccuuaugaacaggaaucgguucaggccggggagaacauauuaagagccuauuaacuucugcagggcuugcuuggaguugaaaagcucuugggagcaaaggaaugauaaaaggaaauuauugccaaaacuaccgagggugcaucuugcagucucucagugggugcgucuguugaauugcaaauuuguuuccugcuggggcuucugcccggcuucugaaguccccauuaaaggucuugaaaggggggauuuaaagaaugauugcauaauguugauucuuuucuugaagaguggauuccccauagcacugggacaaaauuaggaaagaacuaccuuuauuuauuuauuuuuuuaaaaaaacaaucuuuauuuuccauaaaagaaaaaggagaguauuguagaaaucugggaaaauguagggcuacaugaagcuuaggagaagacccugcgggacaacgccguguggaaacuuuuucugaugugcaucugcaucuuacugugagcacuaugagguagauucccccacagcagacauaccggcuuucugcccuuuagucugggcaaagccuuuucuggucuguaaacacccuucaagaguaggaucuggggcaguaagcugcggcuccccagagccuaacagcgugcagagugugacuuuuguauagguaccuggcucccuuguccgugugucuucgguuaccuggcauguaugcauucuaggaaauggaguuccuaggucaguagguuaagguggggggugggggugggguaaaacagauugccacauuucuggauggaaacaguaacacaccugcagcuuacugggucuuggcugucuugcugcugccuuugagucauuuagacuucaugaaaucaaaccgguaccaguuggccagaggcaccguuuagcguggaaacagccgauguugaucgcggggcucagguucuggcuuuguuuggaaaucuaguguguuuuuaauaagccaaacuuugggacaguacucugguuuaacuuggauuuuuuuuuuuuuggauucuugucccaguaacauccugugacucauuuuuauauauuaaguuucagguuuuuuuuuuaaauuuuuuuucauuauuauaaagucaaugucucccaugugccuggugaagguuguguaggagaaaccugucaaguuguacuuuuauuuuccuuggcuggaugcugcuugcucugcaacaucauauuuaagaagaauguaugguuuuaguugccaugggacuuuuuaaauuugaaaagugacuuuaccuuuaaaacucccaaacuauacauucuuccuuccuucucuaagugauuccuauuuucuaaaauaaccccccuuucuguguccacacauauauaacaagcaguagugauucaaugacaaaagucuucacuacaggaugcuaugagacgaacaaauuugcauuuaagcaacaagccauuucuagcucuuaauucaggcugaaaaguuaggaaagcuuguguugguagcuccgcucacaaaagugcuuggaucugaauugcccuccuagaaaccacguaaaauggcugggugaggcucguaacccuaagugagagauuugagaggagggucaucagggcuucuggauccccagccuaggcuacuuagggagcugacagccauugagagaccuugucccaaaaaccaaaaccaaagaucgacaaacaaaacucugagagggaugaggaaccacacccaggacugaccucuggucccugugcuggugaguggguauuacagacacuugugugcucaugagucaauaucuguuccugccuccccacgauucagcaaagccugugagaaguccauagacgccaaggguucuguucugagcacaggggccagcagaugacagcuauuucagaguugcucauuuagacuguggguuuaggaauuaaguauacacaugauacuuguucuccaggcagagugcugcacugggagagauguaauagguuaauguacagauuuacaugagcggagguaagagugagcccuugggaaaaggaggagcgagccgcacagucagaagcucagaaauguauucuccuuauaauuacgguaauucacaaaaacugcacuguaggauguagcucaccaacuacucgguaaagauggaaguaugugucaggagagcccuaacgaauuuggguggaggaccaagggcacacaugguuaagguagcuacuaccuaagguuccugccuuuggggaguagggguacugcucaucuaagaggcugagaugcugaacggaugugucuuuagucaucuggagggaaggaauccauugcuuguaaaugagacagugcuugccugcuucaguggggcucuugauuauagcucuuucagggcuguauuuccaaaugcuugccuccucggccauuuguggucucacuuuggggcuugucuuagguggcucagagagccgggcagcacaggacucaggggccugugcguguuuucagguagguuuuguuugauuguuauguuauagaagcuaaagggaacagauuucuuuacaguggguuccacugcuugggugcuuggaaauuguccauuaccuacagaugcaggaauaaaucuucggggcuucauggugcaaccuaccaaacuaaacaagaguucaaaacccaaugcuucuuacuucaccuguagggaaagauucugaguagaaauuaagagaaagccuugccuguuagagaagccauagaauguauguuggcuuuauaaaaaugaguuauagcagucacagaauuccauauuugggaagucuuaagcaggacuaaauacauuuuugaaggcaguuuacuugggaaauucucccaaaaguucuagaaaggaaccucuaaaauauacccaaaggaaaagauagccagaacuaaauguguugauuguauaauccauccguaucugaggacaaaggaugacucgaucuguuauuaggaugucuaaagcuaccaugggcuuuuaguuucuguucuuucuccugcucuaauuguaaaaucugaauguaaguauaugaagaucucucuguugaacuaggagucucuaggccaggcacauuaugcucuaacaaauaucaguguauagauuaaauuaauugcucucucacaccaguggccgcucuggugugagagagcacaccaauugcacacucuccaauugcaguucugaacggcucugcuaugguagacaguacugaaggaugcaggcaacgccuggguucagcguauuacuuccugaaauguaggguuuguucucccuuuccuugccuuucugagcugguuuguuugauggggauucaaugcccuuggaguacccuucccuagugaaagaaaggcgagcuucauccgaggauggcagauaggggaggaaugugcuuccagguugcagcuggcaucucggcuuugaggcugggcccuguguacuucaccuuuuuugcccaagggauuauagagggcacugguuagcuuuuaauuuucccucgaagauacaguguuucaggcauaagugggguuggcugcuuaauucccaaauucacggcuuuuggauuauaaaaggaauuggcaaagugggaggagagugaccuuuccagcuagucaaaacuaaaagccaaguauuaaauccaagccacgucuguguuuaaugagaggucaccauguuguuuauaguuguuccauuguugcugaauugcuaccgggucugcguuguuugccugaaagugucugagugcuaccauuaaugcucuugucucgccccugcuaucccagaguuaacgauuaacaccuggcuguucacuugugcaaggauauauugacugccuuggaaaaggcauggcgauuguuucaaguuuccuaaagaggaaguggggaggguguuuuugucagcugauugcuggccaagugucagcgccacuccggcuucggaauacugagguguggaaggcacauuuuucuagggaugaagcacccaacaguagugagucuuggaugggagccaacgcggaauuuaugaaauuuuauagaauaaaauuauaaaagcauguucucucacacagcuggccuugcccuccugaaccaagguuucagaccugcaagccuuaggcuguccuuggauauauuuauaguugggggagggaucuagauuauauagcuuaagacagaguguaccuuauucuugucaaauaugcaguccauaaucauuuaauugagugagcaggugagauuccucugugaagaaggcuucuuacagacaguucauucucuaauaaagcacacgaguucugccuuacuuccuuaaggagguagcgcguauguauaguucuagcugggcauuuaauugucuuguucacuuauuugcauaagugagucaugucuguguuaccuccguggaacugauacaguagcuauccuguugagcuauuaguaguaaaaacuggaaaauucuguuuucuuauauuuuuaugcaauauuuugugguuuaauuuugggagggggucuaugaagauuuuagaggugccacugagagaauuuaaccauuuugagaaauuucucccauuccucccccaaauggguaacuugcagagugaagaacaaaguauaagaacagcugauccuguacucggaagacgauaacuuguuuauugaauuagcccagagugugggagcccagcguggggugggggugggauaggaugccaccugugccccaaggacugcucauuagcagugaguguguacaguccaucacccuuacacccuucauugcagacgaaggaaggcauaggacugguucucaaccugugggucgcaaaccccccccccccuuagcaaacauuugcauuacaguucaugacaguagcaacauuggacuuaucaaguagcaucaaagaugauuuaaugguugagagucaccauaggagaaacuguguuaaaggguggcggcauuaggaggguugagaaccgcugacuuagcggaagaguucugcaugcuuuccauuccgaguauuuagcaccuauggacagcuccuccugccagaacguguucagagugcggcggaggucuuccauguacaagguagacacaagguagacagugcuauguucuuuaugaagcuugcuuucuacagaugaaacaaggugaaccaaaugaacuccaugccuucgagccccaccuugauggagcucagcaguguagggaaauaaauggcacagcagcaccuugguggcacgugguggucagugccccuguagagugaguggccgggaaagccggccagggaggaguuaaaagcuagguccggugaccugaguggaaagacaggugucugaagauaccuucugaacggaaacggcagugagucuucacauacaguccuguuuguauguuguacucuaaguuugccuugagcuugggcuaggugagccaggauaccccagucaguuccagaggccacuggucguuugucucuccugaagauccacauccuacacuacagccaggccuucucagagccaggaguuugugcucucugggcuugggggucagugcacccccuucuugcugcuggccgaccuauuguccuggaagcccacugacaguuuuuguccuagucugagcuuuaccucuggcuucccgcagagccucugagauaaucuguauucacugauagcaagauacacgaaaaaugcucuucugugugccucauggcuccucucaguuuggauggccuacccaaaccgauuuaccugucuggcaguagauuuuauuuuggauauaaacauuauaagccagauugcuguuuuaacuacuuaaaaaaaaucauuaaaagcaauuuuuuuuucauuucagaaacgugcuuuuuuacuuucugaaaaguugucuuuaugcauagcauucauaaaagccauguuagaagcaagggcagcuuuuuguagcagaagguaaggcaguauguagagggaacucucaaggaggugugugauucagaguccugcauucacaacaaccugggcuugcuuucagcucuccuggaaggguuccugcaaugucucuugucuccuuaauauggugcugauaaauucauuuggcaacuaaggagucaguauuccauagggaugaaacauucaccuucaggaugaguuucacggacucggcuaguuugagaaucagcagugacuaaauuuaaugaaaauacauagcaacgagagcaggaggcaacacugcuucuggcccgccauuccguuugugcucuaggcguuugucacgccauuucccccaguuuggauuucacuucauaucugaagugaaacuuuauaaaaaccaguucuguauuuuauuggaguuggggaaacauggagccuuuguuuugccaacagugauguacacagugcucaugucacauuuacaugcccauuagaacuaacaucauccugaaguccucuggcuccgcuccugucuuuguggaggagugcaguggcugccugucuuuagucagggcaggggacacgccuugcgggcacagagcuuguuacacaggcguaaggaccagcacccacguaaaacaugggauguaguggcagugcuugaaguccuccugcugggagguggggacaggaggacccuggggagucaccgacuagccagucuagucuuaauauaugguggaggagcugaagggaugacuugggacuuaagaacacuugcucucccugcaaggaguccuguguuugguuuccaggucccacauugggcagcacacaaccuuuguaccuuuaguucuggcugaucucauguccucuucuugucucuggaggccucuauaaaauaguauccacgcauacacacacucauacagacaagugaagauaaaucuuuaaagaugggguggagggcaguggaggaaggcaucaguauggacuuuuuugacauccacacaugcaguacacacacacacacacacacacacacacguacucuuuuuuuuuuuuccuugauguugcuuguuuaaguaacugcuaguaugauggaucaccagaccuuuuaggcauauccagccugagguccacaggccgcaugugucuuagucccagggucauuuguagaccaugucaccaugccaaaaaguugccagugauuccaguagcucucugucuuggagccguuuucauaauaacguccuucuguuagccagcuuucucucuacggaguuaaugcuucuucguaagugcagagguuggucauuacggcucagugugggagcaaaugccuguaauaugucuguaguccaugacucacucgcaagguugauuccaggcgugcuugagcuugaggccggucuggguagugcuggaauuauuuuauucuucauuuuugaaauagucauauaguaaucucccgaguaaugguuugaggauuugugauuaagucagggccucucacugagccuggaacucacagaauggguagcacuaccuggucagcaagccccaagacccuucugucucugccuccccagcccugggauuuauaggcauagacuucugcaugguuuuuaauguaguuauuguugaucugaacccagguccucauacucaccuaccaagcgccuuaucaauugagcuaccuucccggcccuaccagucuguucuuaacuucgucuuuccaugucuuaagaguuguaguuuuuuggucucugaacugaugaaucagcaacagcuuuucuuagucuucgaacugagcucacuguuuucaagagccuugauuguuuccuaucugcuuaaaauagcguccuccagauaacccgccaccaccaagguugggaaaucuugguagggugguuuguuuguaugcugccugccuagauucccuaaccuugauuacuucucuuagcacccauuugcacgcuaucuuuugucauuaaaauaucaaauuagaacuccucaguuauguaaauaauuucauuuaccuaagaaaacugggagaucagaaaaccuaugcaggaccccuaccggugaccucuguuugaacaaaggcucccgggucuguguaaucaaaccuugcagugaauugagaucauuggagauagcugaaguaaucugagauguuugcuagcauaaaacgugguggucaggguuucuaucuacuaaguaaccaagcaguguuucugaagcaguccaugacuugcuuagauucacccagaaguguuugaauucugauaaauuuugggauuuaacagcaaaaaugaguauuuuggauaguuccuguacauucuuucuuuucaauauguaaguaacuuugaguuuuuuuaaauugagaaauugcuuuauuaaaguuaaaagaaaaaaucccugccacacaucuggucaaaaguucuagccauaaaagaaagaaggcggugggagcugacccagccccauuagcacaaguguccaaagcaaguggaauuuuuauuuguucgguuggcacuccguucucguggaacacgccuuacuuuuuugcacagcugaauugcguauggaucuuagauuuuauuuuuagagaaucaguugccgguccuuuucugcauuuaaauucuguuuuguaggagcccgagcgggcucagggaaggggaggccugcucccuucugcucucuuccagcuugugcacucuaggacugggagacaacuggccgucuuggcaggagcucugugugugcagugagcugggcggucuggagaggggcaggcccgagcucauuccauuccuucuuuagcaaggagccugggaggcuggcacaggcccgccuguuucaacugacauuucacucccugaauggggcuuugucuucauacugaaacauaacuuuuucauacacacgcucuaagcggucguuagucggcuuagggaaaccuguacguugcccucaccuuuuacauucuugagauuucuucaguguguugauaaggccuucaguuaacccuuagugaaacagugcuuuaauucauaucaguagagauacuucuuuggcacaaguuagaaaaugucaaguggaggaacuaauuaaugucugcccacaguucuaaccccccagugccucaagauggagcuaggccgugauuauuguguaagaucaugggagagagcugugaucuacuaagaugguaaaauucagcguucuccuucuuaaacacuucuugacccugcuggucuggcgaaugaauuuucacuuaauuauuuccuccccgagaccccgucuuucucuucugaguuccuuggccgccuggcacaugguaggaacuucauguuggucacaugcauuaggccaaguggcauucuugugagcucuacauuauuuccagccaaacucaagauucaauaaacagcaugaggugcugcuguugacgaggaagauaaagcaugcgguaguuuucaaaucucugauaggucaccgcugaggacugaauucggacugacagggaaucuauuucuuucccaaagcguuuuuuucuuaauuugucacuuuuguuuuuuguuuuuuuuauuuuugguuuuucgagacaggguuucucuguguagcccuggcuguccuggaauucacucuguagaccaggcugggcucgaacucagaaauccaccugccucugccucccaagugcugggauuaaaggcgugccccaccacacccggaaauuuguauaaacuuaaaacuggcuuaugauucagaacucaggauccgauacuucccgcuuaauauuuuaacauuaguauuguauucccaguuaucucaugauaucuguccuacuauuaauacaggauaucauuuuagugugaguauagucugcgcaacguagggagaugcugugguacgacguauaguaacuuugugguguuugugguggagcgcugcagaguucucuuccguugcaggcuuuuccuucuuugucuucgugggauucacucaccuguauccccugagccuccuuaaucggcuccucagccuuuaguuggguucuucaggucaaccauguugcuucucugucauagucaaggguugaccaacuucagacaguguguaacuuccccuuaacagauggauagcgacuaccuucccuugcagaagaccgcagcacccugguguggccuccagagauauucauuuagucaagucuuagguucugguucuuuucuucccaggucgagcaauguacgaagaagucucucuuagcuuuugaagcuuaucaaccucugggaugcagaacaugcagacgaguagcuggggacuuaguuuguggagaugcugcuaggaugacugguguguuauuuuagaccugugacuucagccucaggucuccauucuuaaauacuuaaaaugggaaaauacucguugagcuuacaggaccauggagaugagauuaaauuuauggugcaugaacagugucaaacaaacaccuuuaauccuagcacacagaaggcacaggcuguuggaucuaaggccaaucagggcuccaugguaaggucuaggacagccagaacuauaaagugagucagucucucucucucucucucucucucucucucucucucucacacacacacacacacacacacauacacacacacacacacacacaauuuggugcguguaagguacuugugaagugcauccacuagccuaaaaagggggaaaguuucuccaaaggcagacuucauauguauugguauuuggauaauuuuuaauacccgaggaggagccccucuuuuacaaagagaguuuauccauuugagcccugauaagaaguaucaacgauucggacauggacaucugaauguggaguggguccucugcaaggcagcccuggcagugacucguugcugagcugaagaaaucuccaggcuugaaacgugaugccccaaaucagauuauguacuuaauuaauguaagaccaguaagcuucaaaucuuaaaaucuugcuuagcucccuuuaaagcuaccucaacaguuucaaauggaaguuuagagauacacauucuuuuaauuaaggagauauaagacaagauaauaagcaaauaugaccauugccacauuaaaaaaaaaagccucucccuugaaucauuaauuucugcuuagugcuagacaacaaaauacagacaucuuagaacuaaaaccuugugcauucuuggaaguguacuuugaaauguuaauuguugaagguguuacaguaugcauuguuaaacaucuacuuacuguacaugaaauggagauaacuccuugaaaaugaauauuuguuuuauuuccugcagagaggcagacacacagaauggacaagcaugcgucucuaaggcacaaggaaagacagaguuaaauuguguugguuuuggguucuagccuaaugaguauauagaucuuggcugcucuucuuacgagcaauggaggaagaaaaguaguuuugagaaacuauauauauauaaauuuacuuagccaugaauauucuuuuuaauuguaugcaugccugaauaccauuuacauaccuuaaauauguacagaaaaaucuauuuaaagauacauaucugugaucuagagaaagaauuaagaauauccuacuacagagagggcauuuugguuuuguuuuuuuuuuuaauuuaacuuauuguaugcauuuucaguauggauuuuugaacuguuacugaaauuuacagauuuaugaaaauauuuuagcccacuagguuucugcguccuuucagcuuguuuauucuggcuguuguuuuucugcauaucuuuuaauguguauaaggcagauuuuuaguuuuuacucaguuuguacaccauuggcauuucuuccugcagccaauguaccugucuuaguguucuauugcucugaagaaaugugugugcauguucagagagucagacacaggcauacacacacagacacacacauacaaacauagacacacaaaggcagacacacauacacacacacacacacacacacacacacacucacucacucacugggucuggcuugggucuuugaauccuccaagcccccucccagugauucaucucagggcuuccagcgaggacauaucuauucagaagucaguggugcucccgagugcugcugcuaccauuauugccguggauuuccuguguucccggauauaaaugacagccgugacaaguuacuggcugugaaggauugagccauguuggucaguagcuguccucggcucugcugggauuuuaucuguggcugauuauguucuuaaauacaaagugguuucucuguaggacugugcguggccccuaagacaugguuuucgauuauguguucacuugcauuucuucuguuauuugacauguggucacacuggagccgaggcuggcacugaacuccguccgaggcaguuucuuacuuaagccucagagccuugagauuacaagcaggaggcagcgcuuccagcugacugucaguacuuauaaaguguuugguauuuucuguagucaucugacuucagaaaauuacaauuuuagguacuuauauguacauguaaauauucauggagcauucugguuuucaaaaguacuagaauuuaguuuuucauuguuucuguacaaaguaaaaccauuacauuucagucuuuacauuuucccaucuuauauauuaaucaucucuauauauuauauauuguauauaauauauauuaaguuauauauauauguauauauuauauaauguccauacagacaucuaugugaucauauauuauauauaauauacuauguuuuauauauauguguauauaugugaucgaucacacaguucuaaaagaauucaaggguuucuuauuagauaauguugcauguaaaauuggugguuauuuuaaagaugagucagauuuaaaauuuucacuccuuuaaaagccucaaaggcuaugacauuuaucaguaugacuguugaucaugguauucugauggugugagacagaauaacgcuucuaucaaguuagguuacuugucccagguguuagguaucuauaauagaaagacacuaaacugcaacauuuggagauaaggguugggugacuuaaugcuggcacccaaauccgaggcuugcucccuagcaagugccgucucgugaaguugcauccccagccccucccaguuuuaaaggaggcuacugugcaguuguguucugaacuuuauuuuugaguaggaguauccaaagauucagaaauaacaguuuuaucagaaucucuggcacuaggucccacuagcaaccaugguccguuaacuaaaauuggcaaacuucaauaggagagguguucugugggcauggaaaguugaaucacucacuuuuuguuuuguuuuguuuuggcaguguggcaacgucauuuugccuuacaaaagucccuauguuggaauggaggccacagugucagcugugagguagaugcugagggcagacaggauuugaagugacagugaaaccagccuuagugguagcaagacuggaaagcuugauggaccuguaacuguuuucuugagcaauugguaugaugugccacaagccuagaaaaaccaggccagggaaaaaugacaccaauaccgacuugguuaaauaucugcugagucuuucugggacgagggucugccacagcuauguuuucuuuuucauaauuaaauuuuuuuucauauaguauauccugauuauauucuuuuucuuacccccaguuccaagauccuaccuacuuccuuacccaccaaaaaacaaaacaaaacaaaacaaaacaacaacaacaaaaacccaaccaaaaaaccuuaacaauaugacaaaaauacaaaagacccagggagccuuuucuuguguuggccuccucucccagcacagggugugccucgggucugguugagauaccuggugacacgcccaucgagaaaacugacuuucucuuugccagcaggcaaaacuugcaggagccuucuuguuaggggcgggacuuuuuaucuacuuccuguguucacugcagggguuuuguuugguuugaaccaggcacaggucuugugugugcuaccuuaguuucuugcuguguaucaguaucuggaagacucuuguuuccucagaguccccuaucaccucuggcucuuagcaucuuucuuccuccuccuccuccaucccuaaaucccuagguauuugauaaaagauaucccauuuauggaugagugcucuuuuagaagucacgugaucucucccuucagcauaguagcaauuucaaccgaugcauauuuaaagucaguuuccauagugacaucuggugguggcuuugcaaucccgugaagcacguuaggaaugauaaauaguuuuagcuaaugguuucagauuuccagcccuuuuucagguuguucagcuuauuagcagccuuuuuuggaaaaaaugucuucauuguauucucaagguuagaaaguugggcacucagacuucuguaauacuucauuaaagaaagggaacaauuccugauuauagcacacugcuggcagcucauaguacaggcaugucugggcugucuucugugcgcagcaugguugucauugaaagucucccuggucauccuguguggcucccacauuccucaccagauaagcguccugugauuacccuguuccuccccauucuacuagauuuuacuucugcaucuaaccagagggaauuuuagaaggcuggguugccucuuccucuugacacccuggccuuaucuguccucuaauugcauacugucacugcuaucuaaaaggugaaagagagccaggcaugguuugguaaggacccauaaucccagcaccugauacagaggcaggagauucugucucauagcaaccauucugcuuuuguuuaaaaagcaaagaaaugaaagauagaaaauuauaacuaggaacagacaggucuggagggaaaaccgcaacagguugucgaagucgggauaagauucauuuaaagacuagauuuuauuuuucccaggaagaacaaguuuguaacuucuuaugcaaaaaaaaaaaaaaaggaaagaaaaaaaagaaaaaaaaaagucaucacugguuaucagcauuugaaaguugacucagaggcaagagaauuaagaagaggaguagaauuuuaagaaugaguaugguugucucauucacaccccgugauggcucgaaggugucaguuuuauuugccauucuuucccugguguuggugguagcuguguugauuacaggaauaaggacucagagugacucaaagaauaaauauuauuucuggucauacuucuagaugacuggcauguggauuauuuuagagcugaggcuuucuguaaagaaugggcuggacuccuaucaaccccugcgguccaucccuguaaccugacuuccugccauagggaaguggccuucacggucccuagucuuacucucuuaauuaauauuuaauacaacauuguucccaaccuuuccuuauacucagcuauucuccuggccauagcuaggaguucuuaggaggcauucacaucaagaugaacaugacuuuugcccugugcgugguugauuggaccggagaaccaguucuaagcagaaggcuacauagaugagacgaggaaaaaaaauguaaaggaaagccaaucaccggucguccaucacaccgugcuugcauuucaugucuucuccuuaaagcuguuguauuugaaugaauguauaaucuucaccugaguauugaucuuuauccuccaaucauugugcucagaauagacaggaccaggcuuugugcuggcucuggguuccaaggaucugcccuuuacugggaauguuccucacgucugagguuuucaucaugaaguggaaacaauagcaucacuagucgaggcgugucaggaaaggugucacgguacagcacggggcuaccacgaugucuggcauggagugaauccagagaaaauuguguauagaauugucauugcuuuaugaacaucaagagaauuaugauuaagaaaaagaaaggaaggaaggaaagaagaaggaaggaaggaaggaaggaaggaaggaaggaaagaaagaaagaaagaaagaaagaaagaaagaaagaaagaaaaagaaagcaagcaagcaagcaagcaagcaagcaagcaagcagcaugaaauaucuaacgguuagaagugagaggcagggggcagaaccaccaugugucuugucuacuugaaauuuucuaauaacacuucacuuguccaauggguuuaauugcauuuuaauggaguggcagcccaggaaaucggggaaaggccagauuugcuuaagagaguucacauuucuacuucugauuacuuuguuggaggauucuggaauugaaguuuuaauagaugucuguaacugggucuguuuucgguggguauaugauuccccucuucccaguucucucaguaacaacggcccugguuuggaucucaguggaagacucuguauccuaacuccagcuugggcaguuuauucaugaagugcauaguugcuguguuucguaugaggaaccagaaacuccaggagcagcuaggaaagauacacccuuggaguucaacugggagaauuuauauuuuuauaacauacugguugucuguuugcuuaagaugguuaaagauguuaagagguuuaacauauaagagaccugaguaaucucuuaugcgaggcuugcaaaucuuuccuauuuuuuuccuuagcuuuuuuuguuuuuaaggauuggauagccuuaccccaauuacucuggcugucuagaggaaaguuacuccgagucucuuucccugaguuguggcuuacugagugggacugagaccauggagcugagcccucacucugguuuaucuuugguuuccugcuuaaucuccauaaaacucaacauauauuaaccagccauaaauuuuaucuuuggaacacaguguguuagaccaugagaugaucucuuagugccuaucuccuggguuacuuucagcuuagaucguagauuuucuguuugauugguuuugccuuuuuguuuuuuucaagacagggucucacuagggaucucuggcucuccuuguaaaccaggcuggccucgaacucacagagauccauacguauuccuuuaaucccagcuuagaucauagauuuuuaaaguaguuuguuugacacuaguaauuguaaauacuuaguccauauuauaugcuacauaucuaaccauuucauagguauuaacucauuuauccagccacuaaggaguaugcauuuaucuuccuccuuuaggcagggaaacuggggcacgugacacauaagccaccagcggaguuguuauucuucgacacagguggcaucuugugcuuguuguuaacuuucuucuuuggccucuuauuucuagguguuauagagacuucagaccgacuggauagagagucgacuucccacuacuggcucacggucuaugccacagaucagggcguggugccucugucguccuucauagaggucuacauagagguggaggaugucaaugacaacgcgccacagacaucagaacccguguacuauccagaaaucauggaaaacucacccaaggauguaucugugguccagauugaggcuuuugacccggauucuagcuccaaugacaaacugacauacagaauuacaagcgggaacccucaaggauucuucucaauacauccuaagacagguacguugugugugugugugugugugugugugugaguacacucucccaguugagagcuaggaguucguauuucucucuugccaaaguuucuuugguuugguaccucuuuuuccucuucaguuccucagaacaagguuugauuugugggugaaauuuaauucacacacagugcguacucuuugggcuuccuaccauauagcugauggaugaguuuuccuucauagucaaguuuugcgcccugggucuaaagcaguugucauuuuuaaaaguaauucagugaugaugccguaagccuagaucaaauuugcuacuaaguaucugaauuuuuauauauuuucuuuuuuggugaaaaauauuagauuuuuuauuccauacuucauuacuuucuaaguacuguuuuaaauuuuucccagaacucugacuguaagugacaggaucagggccaagccacuuuaggguuggaagacaauacauuguucucuucucaaagacugugacacacacacacacacacacacuuacacacucucacacacacucacucacacacccagggcugaagagauagcucaguaguuaagagccugagcucccuugucgaggacucaacugaguucagcucccagaacccacuuuaaguggcucuuuuguaacuuuagccccagggaucuaaugccuuuggcuuauauagcccgugugcucacagauaaaaccucaaagauauacacagagauucauuuaaaaaugaaucucuguggcccucugcuuuuuaggagcuugacuccacggucaaggucucucgauccugugagcccagacucugcucuuccauauuuaauaauguuuuauuuguuuccugagucuuaggcuucuuuaaauccacccccacccccaccccacacaaaucgaugauccauguguuaucauuuguauagugagcacauagcuccuguuucugcuauggaaacuuuucacguugagugcagaacaauucuauuuauuauuaguaaucaguuaaaacaacagcuacuguacggcuuugaaagaaaaguuuacuugcaggaaacugaaucgcuuagccugucaaugacuggacguuguaugugucuucuuccaucuuugcugguagaaucugacgaaccuggcauucuagagagcaagacuuauuuagcucuucuuacaccucugucucaccuguuuugaaugucagaaggcuccaagcuucgucuuccuuaccauuucuucuccccauaucauuaugucuuacuuuguuucauugaacuuaaaaaaacaaaacaaaacaaaacaaaaaacaaacaaacaaaaaaaaaaaccaagcaaaucuugagagguaccuaaguucuaaguuccuauaggaaaugaaaugugucuaagagcuggugauguaaguuagcaaccaagcauuugccuaacauaagagaagcccuggguucuauccccaauguguguguguguguuagguucuauccccuguguguguguguguguguguguguguguguguguguguguguguguguuugugugcgcaagcuaugguuaaguuguuaguuuguaaagcuugucagcauauuugagccugccauuauaaauacuuuucuauaguaguugagugacuucaagaguucuuuugagugcuuuauaaauuguuuuguuuguuuggggauaauuguaucccagcuuuugggacacacacacaaaaagcuaguauaguuuggauuuaucaagacagauugagccuugaacugagguacauagaagagaaauguguaggaucugagaguagucucuuuccaggagcauugaaggcagcauggugaacuuggagcuaagaaguggguuagcagccugucuuaccuaugccggguagggcuaguguagggcuguugcugcagacugaggugugcuguuuuccagguccgggugguaauuaggucccacuguugcugcgaggucaaaugaaaguacccaaaaccuaagagucaaaaauuuaaagcacgucaccugcuguaaaagaagaaaggugucaguuuaaaauaauuucagaggagguuuagaguccagauagcaugccugaacagaaggaauggccccaguauggaaagagagaaguaaaagccccgaggugauaacuaaaaagaguauuuauguuuuuauuuauauauauauauauaugcauauauauacacauauauauuaugugacauauaguacaauauauaauaaaaauaacuaguuccauuuaaaacugcuuacugaauuagacuuuaaaaauguuucuuauuuuaugccuucugucccucuuuuagauuugauuaaguccccugugaagagacaggaaagcaagcaauacguuuccuuccaguauccgagcaaacacugcagcucugggcauaauuaauaggagacagaaaguuuaaagauggucuaggcuaggucucaggaauagcccugguccagccuugccuucccuuugcguuucucccuuaggccgcuuaggaaauggugccugagcucuucugugcgaacacacagccucuaggaguucacggugagcucucacccccgggugugaggcgcguguauaaugcugagaagacagcuggagagaauccaucuccaagcagguuguuuuuacagcuugaaggcagacaggaaguagaggccgacucuaguguauggggcuagcugcugagaggugugucaguuacaaacuaugguuagagaguuucacagagccccagccauguccuuaacgguccaaaaauaaucaugcuuuagcaaacauacgguuaagaaaaaauagaguauaaauaaguacagcgaggugugucuccagcucaguggaaggucucagcaugaucuucaaggcucaagggacaucaguaggucgucucauccucugaaaccguacagcaggcacugcgucuuaagaggugguuuguuaaaauggaggcuggguggugggagccggugaaagacucucugaaagaagaaagcucuugugauuuacugacccggaacaccacuuggagaccuuaaaucaggguccuuaguaauuaaugucugaaggaggaaaaucaccgggcaggaacucagauguggcuguaguuagucuucucuuugggaucacggaggaagcagacauuagggcgggaggcaggcuuuaggauuagcgaccagcgauugacacucuuauuaaggcccuccuccuggacuccucgggguccuuuguggagaauaugccacagccuguuuccuugcauguuucagcugcuuguuugauggauguaugacaaccacgauuuuaguggcuucauacagcucuacauggugggggguggggggcgcaacaagcauaaggaacaauguguguucgcuucccagggauuauuggauaccaggaagccuaacguuuaaggugucaggacgugaaaggucuucagauuuugcccuguagauauagaagaaacacagggaaggccucgugagcaggggccugacgcagccugugaugaagguguuugcaguaacugcagucacacugguggcauggggcagucaggaaguagaaggcccuggaagagcuguugggcuuauuuugaagcugggagaagcagggagaguagucuguccaagagacaggcuuaggcgacuugacugccggguaaggacugaagcuaguguuuauguggccuuuaugacugaaggagggagggacuuguuuucuagagucuguauaaaguccuuagaacauuuuguauagacuuaaacacccauuuacucacagucauuuuguaaaugaggagagcaucccuaugugguuuuuguuguuguuguuguugacaagaauauguuuuuucaaagaagcuuucuggaacugcaaucauuucuaaaguuuggucuccaagcaucaggcuugaaugaacuucuuuuuuuaguaucuuccagcguuuaauuauggugcugaggcugucuugcuucaucucaggcaguugcuagucuacuaauuauaaguaggacuugaugugauuucucuuuuagggcgcacaggcuaaagguuuagcucacuuuccuaaccuagauacuuuuguuaacagagaguaaacauuaguaacuuuuccuuguuguuuggcuauuuccaguaucaguuagggucaguuugcgucuuucaaaaauugugccuuugcucaaggcaagagagaggcagggacacagauauuuuauuguuuggagccuugaaucugccugcucacgcaauccaaagcaucagagcucugugguaugccaaggacagaggaggggcccagacaaaagccaccagugugagcuuuacauauuucauuauccucugguaaccuuaggaaacugaccccaccuguuagcagcuuugaggagagauacacaguucccagucgccugauaauuuugaagguuacucuucaggcuugugccugcuacggaaaagucccaagucuugugaauuugcuaucuucuaagguuuugauacaauguaagucuuuuuacuuuuaaaaagcucccuugggguauaauuagcaggagguaaauccaccuuuguccagacccagggacccaucacugugucaggcagugagcauauagguauuucuaaagaauugccuccuggguuucugucgucugguucuuugcccccaucccuaggugaucucugguguucccugccauuauauuaguuauauauaaauuugcccauagaauuucacaaaugggcugaugacaugguguguaaacuuggggagaaggguuuagcacuccacuuauuugagagucaugcgcgcugcagcucuguaugagcccuuaagucuguuguuguuguuuguauuccuuauguagauacaguuuauccuuuuagugauugaugggcaguuauguaacuguuacuguguuugguuguaggaaauaaugcugccuuuacuauuuagucuucaggaggucauuagugcguaucuccugguucucauguagggaugaauauucugaaaaccuucaagauagcucauuaagagucacuccccccucaccccacuccccaccccuuuuauuuuugccugcaaacuguuacuuuguccauuuuucuuaccuuugguauuguuaaguguaaucuggccccuuguguagauguagaagcucagguuuuuuuuuuuuuuuugaauccuaaaaauguuuauucaguuucagcuuugcaauaauucuguguauacuccucccccaaaaggcuucauuaaaggaguacuagauaauuccaacaaagauguguguguguguguuuaaauaauaaaaauugaauuuccugauuaauuuuacauauaaacuuauuuaguaucauggguuucuggagcuaguuaaaaaaaaaaagacauuagaguucacuuuaugucucucuaaacuauaacauugaggacacccagaguaucuguccuuaaguucugccuagacugugcucuucauaaugaccauuaauuacuugcauucugugccuaacaacacugggccuugggaugucugcacacaggcacaucccuucucgauuauauuccugacuucauuaaguaauugagucacauaaugcaggauucaaagggcacagaaagauucccagugagugcuuucacuuuuauguaguccuucauucccgucccuggugucuuaagugaguguuuucuuuuucugcauuggugcucuggccucuggagccucucugggggcuggggauggagaauggcagagcaguugccuuucacaggcaaacugacucucucaguuuggguuuccauugcugcagugaagcaccaggaccgaaaagcaacuugggaaggcaaggguuuauuucacucaacaguucuagguaacaguucuucaucaaacacagugagggcaggagcugaugcagagcccauggaggguaacuguuuacucacuauggcuugcucagccugguugcuuauagaacccaggacagggcuggcuccguccacauuggucuaggcucuucccacaaucaaucacaaauuaagaaaaugcccuacaggauuuccuacagcccgaucuuacagagguaucuucuugauugaggcugucucuccucuaaugacuguggcuugugugaaauugacauaaaauuagccaguacacuagcgaacccugagcugauugaugcucauaacucuuuuguuagucugacccacccuugcccugucccuuagcuggaaucuucccagugugcuugcucugagcugcuagaugcuaucuaagccgcccacccccaggcuccuuuauuucaccuuaucuuggccaugcuuucugccccuugacuuuguuccaguacuuagggagcaagcagugggacauaguaaaagauucaucuuuugggcucuccacacugcauaauaaugcagccuguauuuccaagcacagaggcaacugcuucuauuucuuuucucuccuagguaagccaggcaaaaugguuuagaaaaaucccuuuaggguagugauugacaggcucagcaaaugauucuuugacuauagauguguauccacccgccuaccucuggcccuuucaucuaucggcucuuaucuccucuaguaaauagguuacuguuugacuaauuuucauucacugcuguccuucuuccucucuggaaagaaauauaugaagaauuauauuuuguagccaugcuaaauagacuaggaauggguaaugggcauaagcgggcauccuggcuuugguuugugggguuaguuguaucaguaggcacacuguaagucagucucuucauuggcugaaucauauauuucuguccccuugagauauuuaaaaauggguuuggaauuugaggguggcuugcuccuccccacuuugggacaguaauggggauugaacccaaagacccacauacacuaggcaaacacucuuaccgcugagcuauauccccagccaaaguugcuccgguuggguugagguccuacccagucuguucgucucuggaucaaugguuuagaacacuuuaggcucuuccaaugcugcugguguucuuucugaugcacuuugguugucuuugagagccgaacuucagggggcagucaagagagagcagcaaccccuggcuuuucuuucuugacucuuaacuuucuguugugaacuuagacuuccuagcccuucuacagucucuuagccucauuuuugcccauuuuugggaguucaggccacacucuucuuccucugauuugugcuuugcauuuugcaaucaacuuugauccacuuaaauccuuuaaaucuuccugggggaggggccuugugcuaagggcagagagacuccaaacagagucuccaaagggagacuugcauuuuccucacuuuacaaauaauuacaugacuucagagaggucaggaccacccaggguccaaaccacaggcauggauuuccucccugcugcuucuggguacugcgucuuggaugugugagugugguuuugcggugguuauucuguauccgaaagaaugcugugucagagcauaguugcuuuuagucugauacuguuucuguggcccuuuucacauuaaaaaccacaaugcucuuaaaugauccuagcuccuuaagcuugcuaccauuaaccguguacuggaggaauuacugaccauuuuguauaaaaggccagggaaguuuuuagguaggcagucuguccagugucugucacagucauuuagcucaguguuuguaguucaaugauaaaaggaacuuucaaguuuguauagcuuucaguauuauaaaaugugucuagccauucacaauuuaaaguccauacaaguugagcaacaguucccugacacugauguguuauacguaacaauggaaauacuucacguauugauuuuuuuuucuuuuuucuugaaauggggcagcagcuauuuaaauuauuaaacucugaaauaaaagacccaacuuuucccauucuguaaacaagagugcauauagacagacugaguguugccuuuccaggcgcuuaaauuacaacacuuagaauaugcguuauuaagcauguuuuuugagauuuaacaaguuccugguagauguuuagaaguggguagcaauacuaauuaguucuuuuccccuuuaagaaauaaaucauuucucacuggaagauaaaagaugccuaaauuugauauuuucgcccuuguacugcugguauaucuuauuacaaacagccagagcugcagugccagcuccccugguuggcucuugguucuuggaagguuccucccuccccuguuuuuuuucguaaccuugucugggacugaguuguucauacucaaaaggacuacauuauacauuuguugugcuuuuaggagaacaccaauauacaagggccucugauuuccuugcuuacauguagaauagaguauuucauaaagagcuaucugugucggguauauaagggauggugugacuguucaguagaagauuacaaacagauuuaguggaaauagaauauuuacauuuaguaaucgacaaaccgagcguucuuuaaucacugcagaauacugcaguggguaguagauauacugggcaccuaaucgcauucuagcugcaugcuccuuuaguaagugagucuuguauuacugaguaaugaggcaauaagaaaauggcauuuuauuguggcuggaaaggagaccuaacacaguucaauaggaaguaguuacagccgcaaacaacuuccgaggguuuccgguguaacauuugauagcucuagaaaggaaggaacugaaaggccacucacgccacaauggcagggauucauuaacaacaacaacagaaagucaccuucguguauuuuaagggcuauagacuuuuuuaaaaucuauuucucauuacuaguuuuuauuuuauggugaaauguauuaccucuaaagucuuaaaagucagguuuuaucuccugccuuaucuggugcauuuuuccccccaucaaaucuguuuucgugggauccuuagggucaguuggaucaaggagaauucugcgauucuaggucacugaacgucagugacuaaaguacauguaagauuuugcacuuaagaugcuuucguugaaguuugccgauguuaaccuuagauauuaaccuuacaguugauugagugcuuucccucccuccaggccuccuucccuccuacauaacuuauauagaauacuaaaaacaauuaauucacagcaaaauugauuugccuucugaucuuguguucugaaaccacuaauuuccaccaggaaacagcucgcagaacagauguaaaagcagaagaaaagcgggcgauacugaccucagccccuccuuguguggcuucagagugaccgucugauuaauuuuauuaguguuuucugcggaccucugaaaguucgaguuaagugaauuccgagcuccuuuccagcccugacaggcuaugaauagaauuccauuuuuggcuccaagccuaauccugccggcaccaguacugcagugacaaacaauagcugcucagauggccacagcugccaaagaucucccagccaacugcaguuagaaccggucucagaacacuaccuauaggaagacagcgcacgcugccaaggcucugagagccuccgacagaagcucuaagaguagaugcacaaugacagcuauaggagaguugauggggagagcugaaccuuugccuccgccuaugacgcccuccaagucuccagcaugggaaaagggagacguguuguccugcccccugauggucugagcuaagcaagacucugacuuuuucauuguugguucugaucuugcccuguugcuugguucucuuccuggcuccaguccucaagggccaggaccuuucuguacccaguuauuguauccaugacagagccaagcacagcgcuggcugugggaaugcuacucacucccugcuugcuuuccaguucacugguaaaggguuuaaaaacucagccaguuggaaugguucugcuuuccccaggcccccuuuagcauccguugcuugccugucucuccaccuuacccacacccacacacacccaccccccuccucugugaucuucccagcugcuacagaugucuuugguccgaggccauuuuuuauuucauuagagcuguuucaaauauacaggcuaaaguguucauggagaagaugcucaugcagucacaugguacacaugguauuucuuauugucuccuauauugaugccucagaguacuuuuuugguuuuucgagacaggguuucucuguguagccuuggcuguccuggaacuaacucuguagaccaggcuggccucgaacucagaaaucugccugucucugccucccaagugcugggauuaaaggcaugcgccaccacugccgguagaguauuuuuaauaugucaucuuaaaacauaaugauuuauuuccccuaugacuguagcuucugaguuccugaggcaguacaacugacgauguguauuuuaauguuguuauguuauggagacgugaagagacuuguuuagcagcuagaacacugucuuuaacuacugcuauuuuauucugauaguugacauuauuuuugagguuaaaaaaaaugguaucaguguguaagaggaacagagagauagcuaagaugaaaaagauagguuugagaaugcagggagagugaguguuuucugacuagagaggauacauuguccuguuaguuuuggagcuacugucuugauuaaucucacugaugucacugugcccugccuguuucgguguuuuuguuuguuuguuuguuuuguuuuuguuuuuuuuuuuuuuaggugaaccccugagggcauacauuucuacucagguggcagaaaugcacacuguagaacaugguauaugagggagucacacuguauaacaugguaaaugagaaaugcacaguguagaacaugguauaugagggagucaagggacucccugggauuaaaggcguguaccaccccugccugggcgggaauuuuaaacacucuccacuucuaggaaauaugguuuguguagugggacucuaauuuagaauaaaauucauuccauuuccaguugcuuuaacuuauuagaagaaguugucucccacuugccacuguggugguuuaaaaugaaaacgaaaaugugggacuggagagauggcuuagagguuaagaaguugugaauucaauucccagcaaccacguagugacucacaacuaucuauguauaaugugaucugacaucuuuccuagugugcaugaagacagcauacuuauauaaaauauaaauauaaaauauauauauauauauauauauacacauauauaucuauaagucuuauuuauguuugucaauggcugcauaguucaggcuuuagaaaucuguauugggggcuggagagauggcuccagaggaccugaguucaauucccagcaaccaccugauggcucacaagcaucuauagugggaucugaugcucucuucuggugugucugaagacagcuacuguauacucauauaaauaacaaauaaauaaaucuuaagaaagaaggaaggaaggaaagagaaagaaauacuguauuggauucuuuuccaucuaaaauuuccacccaguaaauuguucuccuauaucuuuugcuuugaguuuuaacguauuuuuaaggcuauaaaguuucaaguaaaagauuuguuaagaacugaagaucccuuccuugagaauucuaguauaggaaaggaaacaccuuccuugccccgucucagucucuucccugaccaguuccuccuuucucuuuugacaaauugcuuuguaaauauuuccauauacauuuuguauaggaaguuagcauucauacccaaggcucacaauaacguuugccucuuaguucugguagcucuuugucuaaagguugcucaaccacuuuacugacugccccuagggcuuaucuuauuuugauuuuccuuaauguuucugauuccuagaaugcuuagccuggcaccaaaggaagcacccaauuauugugcuaaaaaggaagcaggggguggugggucacaccuguaaagccaggauucuggaggccuaggcaaaaggaacccaagaucuggggcagcuagggauauccagucuccccaaacaaaacugaaagcagccgcuaacucuaccaccaaaaaacaaaacaaaacaaaacaaaaggugcugcuuuucccuguggccagcucagcuuuuucuuuuugaccugugauaugacaacccuuuacuagagcccaugaaagcacagccugaugauacauuuggaaaaggaucguggcauuucuugaguuccuauguaauuccacaggucacugcacaguuuccaguucagcacgucaaaugccuugaguuagggaccagucagagcccucagguugggaauuugcaagcuuucuguugagucacuaggagaggcgccuuccuggguuugugccuaaucaagcacagcuguuaaaaggcggagccugggccuggggcagcuguagaagugaccuggaggccacuaagucuucccuugcuugcuucugaggucuucugaguugccuggagcugucuuaacugggacaaaccugcugaagaaguuugugccuuuaccaaaaccacgguuucgaaagccuaguggccagagugcagcugccucaggccaccuuuguauugaagcagcugggaugccaugauaacaggcuggcuggucccccuagguguaacugcuuacaagcaccaggaaaggaccugugacagcugucaaccaagaggucacgucuucuggcccuucuacagcuuggcuuauuuauuuguuuuuuuaaaaguauacaugaaagagugcuugcaccgaacagacuuauaaacauuguuagcacugucacauuaccuagaccccucacauaacuuagaccccucaccucugaucugucuuaccgucgagggcaagagcuuugugucucucucagaggauacauuuggggaggccauuuugacaagcacauugaguaauaaugcaggcagaacaacuggggaacucugagcugguuaaauauuacggcagcgucaccggggccuagcaacuuaauuuucaacuuuaaaccaucagaaaagccaucaaaugcaaaaagcgugugcugguaaacaaauuaauuuucggaagucagguugaacacaaagaugugauuuuggggggguauuaggcaaagcuauaaagugacaaugacaaggguucuucaucuccggcugaacucugugaacugaauucuaaggacggagucugaggauuggaggacagagagugguggcccccacgccagaacagcggaaaacguugcauuuguagggcaaauguuuacaagccuggauuuugauaacggauguauucgucauugaauuguaucuuuagcuuuuuaaccacaaacauauucugaacauuguugagccacauguuggcauguaauuuggaacaagaggcuauugaaagcagcaaaaaugaccagugccuuuuuaaguuauuuaaauucauucugaaaucuccacuuucucaguuagccuggccacauuccagcugcucagcggcugggcgcaauuagaugcuacuguguugggcagugggaauugagagaauuucaggcuaagagaaacugcuuuggauagugcuuuauaaggucaaaagcuacaguggcucuucuuauuauuguaaaaaguaaaaaauguagccaaagacauggaaaaggaaauaaaguaggauuaggugacugcccugcccccacccccuaacccucugcugccugccuccccuuccugguuuuagucuuaaaggagaaugauaggaagaugguugaaagucaguuuccugccauguaggguuaagccgguggcuggcacacacucaggaccuugcccgauagcuuuacuguuuguaaauuucaccugcuacagaucucaagugcuccgcccuucaugguaacuggaccucagucuuguucagaaaucguggguuuucacccucuggcuggcuguccccuuguguuugugaugcuguuuaaacuaacuucucucccuccucccccucccccuuuuucuguuguuucuuccagagccucacuuguucccucugguuuucuuuuuuuccccugugagggucugaauggacaggacagaguuguugaauaagcguguagcugcuccaucuccaccuagccggccuuugauaggugccugugugugcugccuacccucucgaagaccuugucuuagaggagguccugaguuaaagaauuuuaagguuagguuaacaugggagaguuacagcgaaucuaaacgucugccuuaacuuucuaaacgugggcauugaugugaaaagaguacaagucacuugucaguucugcucauuugguaagguuugguguucuccuuuagucucauucacacuucugagguaaauuugaggauacuaauuagugugaaggugggaaauuuaccagcccuuucagccugccccauguauagagaauguaauguuuuucuagaucaaggaaggaacauuucuagucuuuguccccucuuuuccuuucuauuuuuaacuucacgaugcuugcagaaaaugacaguagaugcaggaaggggccgccuguggugugcaugcucucugcuuuuaucuucucuuucaguuucugacuuacuuuuuugacccaccagaaugaauagugacuaaucacggccauuuccccuguuaagauuugcugaauucacagucaaggcuuuacaaagaauugaaauaccauaaacacacuaaguuauguguuuaaugcgaugggaaguuaaaaaaaaauucucaucugggucccuagagaacucaauucuaacugaccuuguuaaugagugccuggugaccucggagaaaaauuaacuuccuuuuagcucagacaccugaccuuggucauugugcccuuucugauaaagggugugucuuccugggauucagggggaaacacugcaugcauauacaucuuuuuaaaggaauguauaauauuucuuaggacacauaaugccucacucagauauuaacaccuacaagguuagucacccagugaauauucaguugugaagcagguguuuguccaguggggagggaggggguugggcgggcaucagcaggaagccgaccugcaagcagaaugaugaauuauaaacacagaacaagugccgugcagcaggccagggaugcugcagguugggcuggcaccccaggguguuaaccucucugugugccuccuaaaguguaccccaggaagguggggcacacccuagagaaguggcuagcuucccugcugcaguaaggacuuguacuuuagaguucauuuugcacgaaguuucuguaguaagcaucaaacauacuguacuccuuugagaaaggcaccucucuucacacugcgcgucagacucacaggcauagccugugcugccuggcggaggcuucugggagauagccauagaaaccguggauaggauucuucugguaggaguguucugagucuaggaaaguuccaaauuaccaugcacaucgucuacaaaaaaaauaaaaauaauacaaagcaagcggaguuccuuacaggaccuuauuuugggguuguauucuacauuuggaucacugcuuuggcaugaacaucccaugacccacauaugcgguggcccucacugggccauuagcccuagggaacuuuacaguugacucgguuuaaagugaggggauggcaguuaauugaaguaggccuugcaauucauugcauuuaaauagaaucucaguuccucuguguuacaguggugaagggaggcagguggaggguaaggggauggggugguggggguccggggagguguuuaacaggaagccuggagguuuguuccggugagucuaaacugaaaccuggucaaguaacuagguuccauguugaauugguaauacagaugguuaaauccuuuguuagcacuuugauguaagugaaguguucauggcaaauuuuccugggugcccucggugaaugccugagugccaggcagaaguucuucuugugagcauaucaugcuauuuuccgugccaucuuaccaguggucgugacuaucuuaugagagcuuuaggacagucagguagaacagauaaaagcgauuuccuguuuuucaauugcuuuaaaaccacaguuguuugugagcggguggcgguggccuaugaaccuuuucuggaacagaggacuaaaaggccuguaccauugaagugcuguccuguuguuacaagaccggaagcgucuucuugagcuccaguugucuauagguagaguuugggaagagguccaguguccagcaguaacacaaucuugugguuuguugaaaggccaguuggaagguugugcuuagaaguuauuugagcaguuauuuaaaaacacaaagcauugaguuaauaaacauauacaucugguauuugcagauuuagagaaacauuuuauaauagccguuaacuguaaagguaguuagggauaugggaggaaguuaacuaugaggaaagccgguuuucuuuuaaagggaguuuucacuaguucuuugagaauuaucuccaguguguuuugaucguacucauuucccuccccaacacccuuccaauuucacauccucauuuuaaagaguguccugccaagucccauguauacugcccauaggcuuaaggaguaugggaccagccguuggaggagaucugucuacucauacagggucacacucuuaacgaaagcuccuuggccuccuggaagccguuaagucaguagcuccaugggaagcgguaggaccucaggaguuucagcccagagcaucuccuggcucugucguguucagacagccacagcugcaaacuccugacuuauugaacuauuuuccuggcaaugcugggaagcaggaucaacccagcaccaaccuggcuaagugaacuuccccugaaaucaagucaaugcacccgcugcugcugaugccaauugcaccaaugccuuagugcagugcuucucaauccgaggguuggggccccucugggcagucgcacgucucuuaagaccaccagaaagcacagaaauuuacauuacgguccuuaacagcagcaaaauuacaguuaugaaauagcaacaaaaauaauuuuaugaugggggucaccacagcaugaggaaauguauuaaagggucgcagcauuaggaagggugagagccgcugcuuucauggcuaguggaauucacuuuagcgaagcauccagauacauuuuaacaauuuuggcagucuucuagcucauggcauauauugaugauucaagagauauuaagauuaaaguccuagagacagguugacauuuuauucuaguuugauaauauaaucaaagaaauggggaauacagggugggcaucauuuucuuauucucuuauuauaaauuggcugacuguuguugaaguaauaacaacagucagccaauuuauaauaaggaauaaaaauauuuuauuaucuuuuuaauagcaauucuuuauuugaagauagaugacuagaagauaguaaguuauagguuucuaaugguuccuuuucaguaugguucuagaacugaauucaccauuuauuuaucuuaacucuggagcagguauuagagauacaggaagagaauaaguccuggauaacuucauuuuaccuuuaaaauucuauucugaccgaaugucugaugaccaggagauguaguagauuugaguucuucccuuuccauaaaaguucugcccuuugcccgguguucccaagaaucguuagagcaagacagugcacagugugccugcggcuucugaguaaacuaguccgguguggggguggaugguauuucgcucugaucaauaaguguccacccuuuuccaggucucaucacaaccacgucgaggaagcuggaccgagaacagcaggacgagcacauucuagaaguaagccuuccuuucuuucuuuuuuuuuuuuuuuccugguuuuucgagacaggguuucucaguguagcccuggcuguccuggaacucacucuguagaccaagcuggccucaaacucagaaauccaccugccucagccucccgagugcugggauuaaaggugugcgccaccacacccggccccuuuauuucuaacaaaacacccugagagcacccucacuccugccgucugucauucauggcugccaaugucuuauuaugaauauccccucucccccaccucaguccauccucagaggaaaggaacucagccccaaguaccccuuaguacccuuuugaacuuuguucuucuuuaccugcgccccuuacacaaauuuacaaauacuuuuguaaccaaagucauuugaauuuuauuugcaggagcgauguuuuucucuguaccuucuguagacuucucccgguuaugccuguaagacauaucuauagaucaaggcuaacuguugauaaacuguguguuguugauuuccaggugguuuuuaacacuuaaaucauuguguuagucauauaguaguacacuagaauuuguuuguaaccuaaagaaauuuucuaaaaauaucaaacgucaaaggagguggggguggaacauuuccucuucuaaaauauuuggguaauuucagauguuuuuugcacugacucguuuuagcccguuuugguugggagacaauaguucgcagaaugacagugugggagugguuugaaggugacagguaacauguaccauggagguggacaggggcagccaccuucagagacagggcacagcagagcaagccgugccucugugaacuuuucucaucagaugcuaauuucacuaucagagccaggcguagggucagcugcuuuuguuauuugugagccgacugugugacauguccaaacucucaacagcgugguuuguagagaaaauucuaaacgaugacuugcgauuucuuuuaaaaaagaacuuauuccuacugucuacucaauuucaucuuuggucaaaauagccuauguuauuaguaaaauauuucuuuuuaagccugcaugugcaugugggugcaugcacgcacgcguggguuaccagcugccuucagagccuccgagucuuccuaacagugauucuuacuggagucgagcuuucauuuacagguuguguggcucccuugaauucauuuucuuuauuacagagcagggcuuugaauuuucauucaguuacuacagaaauugacucagggaagggauggaugcuggagaaagaaagcauggggaaguaccaaaaaccucaggcaacuguggggguucauccccucucccucugguuguaacuucagguuucacaaaaguucucuacuuauuguagaguguuaucucuuucacaaggagcgucaaaagccacaugggagcagcuauaaggcacaaaagggcuuugcagacagugcuaaggcauugacccaaaagauguggaaggcguuuguguaugggcuguaugugucugucauucuuuggugucuguauuugaagaccagcuggugucaguuuaccugcccuggagacaggaguauauuacuucagacuuuggaaaagcuuauuuguugacaccgaacuuagugaaaccugcgauacacaguguuugguuacaugucuucuccaguuugccccuccccuccaguuugucccaccugacaugugacaggcaggaaguguucagaggagcuaacacuaaaacaaucauuuuguuucauccugaaaagcuuaggaagauaaaccuugugcuucaauguauagaaacaacuguuaguuuccuaaauccucugacaaggcccgugaugauacauccacacuuuucuuacuaggauugacaacuaccaaguuuccaaaagaacguccguucaugaaaaauuuuauucucucaacauuuuuaguauuuucaguuaauuuagaaggaggcagagcuugacugaaaggaguccugauuagggccauuauuuuucacacacacagauguaaauguaaacuuucagggugauauagacucagauguagcccauugcuuagugucagauacuggagcacaugaguaaccuagaagcaaauuacuuaacauugccuuuucuuuuuuucugaaaauccugugauacaaugggcguaaguguccaucuucuuaaguauuuaaaaugguauaagaaaacucucaaacucaucguuagcauucaaaccuaugauauuuaaauuuguaauaaguacacuuuaaaaugauacuuuaggauuauuucacacacacaaauccacuaaaaugacaguuuuaaugugguauguggagacuuuguguuugaauacucaaagggaauuuuuuaagaggacuuaaaaauauucaacaucccuuuaauuaaccuagaaaacacucguuuuuugguacucugacauguuguuaucucuuaccuuuaaaacgcagguuacugugacagacaacgguguuccccccagauccaccauugccagagucaucgugaaaauccucgaugagaacgacaacaggccucaauuccuucagaaguuuuacaaaaucaggcucccagagcgggaaaaggcggacggggaccggagcgcuucgaagcgcgagccccucuaccgcgucauagccgcggauaaggacgaggggcccaaugcggagcucuccuacagcaucgaggaaggcaacgagcacggcagguucuccaucgaacccaaaacgggaguggucucguccaaaaaguuuucugcggccggagaauaugacauucuuuccgugaguccgauuccucucuucuccauugagaaagcaguuucagugucgcaaccugaacuuggcguuuggggagcgcggguuuauuuucuuacuggcucucaccccaacauauauggccaugaaacuccucaucagccagcagucagcauacacuguauucagacacaaguuuggaguaucugacacuuaguaggugaucaaacuauaguugcucugaagcuugccgaugucacaugugauuugcuguuuuucgucuccccguucauaucuuauagauuaaggcaguugacaacgggcgcccccagaagucguccaccaccaggcuccauaucgaguggaucuccaaacccaagccguccucggagccgauuucguuugaggaaucgguuuucucauuuaccguaauggaaagugauccgguggcucacaugaucggcgugaucucaguugagcccccuggcaugccucugugguuugacaucaucgguacguggcgggcgcucuuagcucucgucauccuccucugggcuacugacaggcugaugugguuuucucauguuagaaugugaauuugggaaaaggucuagaggugaagaauuuccuuagacugccgugguuugagaccagcagaagaucucacaacauauagucaaauaaguacuccuggguguggagaaauggauccacggagagccaggggcucuuccagaggacccugcuuagauuccaaaacccucgugacaguuuacaaucuauagcaccaguuccagggaaucugaugcccccuucuggccuccaucgucacugcaugccugugggauugauuaugcagauuaaacacaauggaaaaacauccauacacauaauaauuuuaaaagaauaaacauaaaauagccauccagucagugagcacuuuuacaaaauuugcuuuuggacauacacagguaguuuuaguuuuaagaauuuaaauguuuuggaccaguuuuuccuccuucaccuccuccccccccuccuuccccuccucccucucucucucucucucucucucucucucucucucucucucacacacacacacgcacacacauacacacaaacacacauagaggcgugcuauuauuugugauuauauggaauuuauacuguugaccauagcuucuuaguguuauuuaccucauuuuuucaggaagcuccauccuccucuaaaacuuacaugcuuaagucagcauuuuugugauuuaaugaacucacacauccucggcuuacuuuuaaaagacuauaacacagcucuaaaagcucacaggguccccugcgccauccacccacuuuagacaagcaagcucucggcugcugcaccacacacuggacuuuggggauuuuucuuguuuuguuuuuuaaaucuugagacaggaucauauuaaguugcucaggguggcuucaaacuugcuauauuucugccucagccuccugaguuagcugggauccuaagcaugggcuacagagacuagccuuagcuuuuuuuuuuuuucucuuccuccacaacauuuuaaucacaaggaauacuuaaugaaucagaaguguguuuguaaccaccaucuggaguuagaacucagccacuuccuucuacucuuagcuguguugccucccagugugugaaaagguucucgcugaagccucccucacugucggucuugaagaggaaaagacuagggccauagcugaccauaaccacgacguuuaucguuccucuccucacacuucuggauuaagcaucuuacguugugccugcaguaucugacuuuguccccuccuccccccacuguugggaaccggucugacugacuucuucugugcuugcuuuccacgcuugcuugcuuccuuuggcugugccaggagacgcgcuugcuagagaaguguuuuacaucuuucagcugacuugugacccgaacuguacagcagaagguaucugcugagaucacauaauuucccacgugauuaugagaucaaaaaaaaauauauaucaaagcauggauuuuuguuuccagagacuuuuucccaccaugguucuuuucauagugaaugcauggcuacccaucccagucacaaacauggucauuuuuauuuuaacuugucccugcaucaguaguuucugguuugauugauugguugauugaugaugaugauguguguguguguguguguguguguguguguuuuguuuugauuuagcuguaggauuucagugugucauuaagccuuaucuccauuccacuucuuuucauaaugugucucaauucccauaagcuugaaaagagucuuguuuagaauguaauugggggguauaucgggauaguauugguaggacaggagauugguucugaaaauaguuuuaaggaguucguaauagauuugauucaaguuaaccacgaguguuucuuucagaauuagcguguguuuuuaguagucauuccuaguguaguguacucaaaauaguauaauuguuuuccagucgugaaaacuauauggucagugagguuuucauaacgauguacaaacuuuaauaauggccgaaaagucagaagugacugacugguugugucagcagggcucuuugcucguggucuuaguucuggaccucccucgcauuaagguccaguuuuucucuaaaacgcucuaaagagcuggcuggccauucugaaaucacagguccuuggagucacucugauuauuguauuaaaagucuguuuuccuggccauuaagguucagaaagccauaaaacaccuggcauaucuuuauugcaugauuugcucuagcacugcuguuuguccuaauuucagguggcaacuaugacagccacuuugauguggacaagggcaccggaacuaucaucguugcuaagccccuugaugcagaacagaaauccagcuauaaccucaccguggaggcaacagaugggaccaccacgauccucacccagguaaggggacaccagugacacaugucugucagagagaccgagaaaaugcccucacagcaggaugugcgcacagcgugggcaguugugugcugaugugcacaccaugaguccuuauuuaggggcagaaaauuuauuaaugcaaauccugauagagucuugccuuuugcuuagcagucucauaaaaacuucgauaggaaacuuaaagccagacuacacccuuaccauuuuccugucgaagucuucuuagcuuuacauucacauuuaagcugugugcacagaguuuuaccacgguaugcguuguguagaugguucucuugaagcucuaacaucccaaguugcugccaucacacccccccccuucucccuccuacuuuaucauauaaacucaagcucguggaagcugcagcaacaauccccauccguguuuauuuguugcuaucugagaaucaauagcuggcuagguuucugguuuucaagcuucaguguuaaaaccuuguaaguuaauggacuucucuguuucaaaugaauucucuuugauucuuagaacuggcuguccagaaugauguuucugggugacgaguaauuguggguuuuagaaggaagccuccauucauucauccauucauucgcucauucacaagugcuuguugaauaauuguauuacaucacauguuuccuuggaagcaauaauugguaacggacccaagucccauucucuugguccugagaugacagauaccaaagacuugugugucacuuaaauaucccuaagaaagccaacgcuuagagcccgagaugcuucugaaagcuauuucuccaucuuuagauuauguucucugcgaucuuaaaugagacgggucaucuccucuaacagcuaauuucguuaauguuuaaaaauuacagucugggauguauguucaguuaauaagugacuagguaacuuaaggggagcuguaaaaaugucuuacuccuuucuccagacacuugugauuugcauguguguaagacugguuuugugggcgguggugucugcuuuggggucauuuuugaguugccguguggaggaugcucugccauuuugcccuuucugauuuggucauugcucuucucguugaagugacaaggagcagaaauugauuuuuucuuuugggaaauaagccccugauguuaaacuauagagaaugaaagugagaauuaaaaaaaaaauuacaauaaaccuuaaugguuauuguucgguagauuuacacggucccugugcacagagcacagucuacuucacaggacugacuggaaggugguuggcgggacuugggggaguguggagauggccauccagccuuccucauugccacaaccaugucuccauauggugacauuaucucauuaagacauaauuaguaauguaacccuuccuuuuccgaaaaccgcgccuuuaguuagcuccuaauaugaauuuuugaucuacauuacuaaaacuccccugaaaugcaggagauucauuaguguuccgucuuuuaaauuccagggugguguguauaguccugugacuuacucuggagcaugcucagacaguccugacaguaucccaagggaucacuggcaugaagagguugugggaacauaacagaacugugacagagcccaggcugaccuggggugguggggacaaagggaacaggcaguaauuagguuuagguuucugucugggacugugcacaacagggagauagagaucuggagcggaguaggguguauccugugaggagacucucggcuaccugaccugugcugauaaggcuugcagcacuggcaguugcaggugugugggugaaaaucaagaacucgcagagcggcucugugcuaaucagguugguagcacaggugcugggcguaagaggguucggcagauuuccugucagacccaggagagcaggaggggggcauggggggcauggcggaugccacuguuuugggcacagggcuucauccgucugaguucugggcacacagcuucauccuucagcucaggacgcuucccagccugaaguggagguuggaucuuucuacuuucucuccuuugccucuccagauaaccuacaaauccagcugcuuuuuuuccuuuuuaauuuauuuuguaagacagggugaaggugguguuggggcagcuuggcucuucucacauucucuuccccuuucuccggaacauccugaucucuacuuucugagcuuguuugagguuugucuccaccucuuccuccugugcaggggcaaggaucaggcucccucugcuuccguugccacaucggggaaaguaggggugcugcuguuugucuucccaguucuuagaagggucaagggggguggcucagggggcuuguucuucaugcugcacugucugucccuaggacacgcucacacgacacagacaucuuacagcaucaccgugcaggcuccugaccccacaccuccgcaauugcacguacuucccugaaacccuccugguccacuugacggagacgaggcgguggaauguguuuccucugaugaaguggacaggauagcuaauucuccauccuucucucgggacuugaggcugcacguauucagucccacauccauccccauucuuuguucuuucgaguccaagucuuuccagucucuaaaagauagguccgcauccucaacuuugacuuuccuggcugaccauccucuucccaggacuccuugcguuggaaggucccagccagccucuggacuugaaaaggacucaucuuauggugugcuagcagguuuucggcucuguagaaauaggagauugcccagggagauugaaagaguacuggggacaguuucuguuacacuugcuuuuuacccucaggccuugcgggagagcccugaaccaaugcucagccagcaugcggcucacggguuaccuuaccuugucacaauggaucgcuaguucuuuucagccuuuguugaguaaugguuaaccguaucugcuggagcagcgucaaacuccugcccaguuccugcacuauggucaacuuaagcuuuaaauuuguaaacagaccuugaucagauuuauaaaagaacuucuuuuuacagcagugccuccuggguccucuuuaaucuuaaagagugacucagcgguaguuucaaauggaaacauacuguucacauaugaucuuuuugugugugugugguuuggugagcgaacuuaguauucacauagaaugggugugagaaugcauccuuugaugcugugguguucuuuggggacccugguacaggcucaugaaaauacugucuuuguguguguggaguggugaggucuauaguuaccuggcacugcuaaaacuuuggccccuuguuccucuuaaacuagcaaauccucguguucuguagaagccaaucgagcucagcuuucuuguucauaaacuauaaaccauauuuuaugauuggugcugacuuucacuaugccuuauccaccuaugucacuucauuccaaaaauuaaucaucugucaagguaaauauguuuuauuuccaaauaugacuaaguuuuuugacaucugucucuuugcucuaaagcugucguuauaugucaccauauuuacaggaguuuuuccuuuucaaccuucuuaauuacuguuaggaaaaaaacauucacuacuuauauaguguuugaagucacagaaauauaacuuaaaaccacagggccuuaccuuaacagccgugggauuucuaagacaagcucaugcaugcuucuuagaaagugcccaguugcugaauugcaucuuuagccauuucuaguuguuccuuuguauuaauaacuuauuaggaacuuggagucucagaguuuagaaugaggaauuagauaguguuacuaacccucucacugguguaaaucuaguguagaaaauggguacacuguaaucccggcagagucaaguccaauaccuuuccaugagucauuuccaaaggucucauauagaccuaugagaaauucgccuguauuucucaagcaauuuucaacuacaaucugaauucugucucuauaguuauuguuaaauauuaagugaauagcauaccaaagacaagcuauagauacucucuuugaaucuagauuuuuauugcuuuuuuuuuucucguguccauauguaguuugguucaauggcaucuuuucaauauguauguauuuuuaaguauuaaaacauaauugugaaugugucuuuaugugaguguccuugccacucguuccagguccucaucaaaguaauagauaccaaugaccaccgcccccaguuuucuacaucgaaauacgaaguugcuguuccugaggacacagagccagaaguggagauucugcagaucagugcaguagauagggaugagaaaaacaaguugaucuacacucugcagagcagcaucgauccagccagccucaagaaauuccgccucgaucccgcaacaggcgcucuuuacacugcugaaaagcuugaccaugaagccauucaccagcacguucucacggucaugguacggaaggcacccuuuacccugccgucucucuuucugacuggcagguuuccugggauggaaaagcauagugauuuuauuuauguauuuauguauguauguauguguguauuauuuuauguuuuuguuuguuuguuuuuaauccacaagaaagaagaaccccaguagauaacauguugacuuuucucucccagguccgggaucaggaugucccugugaaacgaaacuuugccaggauuguugucaaugucagugacaagaaugaccacgcaccgugguucaccaguccguccuacgacgggcggguuuaugaaucggcagccgugggcucaguugugcugcaagugacagcucuggacaaagacaaagggaggaacgcugaagugcucuacucgaucgagucagguaggucggaagccgugcagucucgugacugugcuugaacggcguaucucgcauuuucuaaaacugcuucuaggugcugaagcauacuuccacauagcgcugcagaaauggauuaaaucuuuuuuaacuacuguuuaauguauaaggcaaaagggauuuagggggggaaaaaaaccucugccaaggaacaaagauaaaguccuaauaagcuugagugucaagaauucuggagauuaccaguauuaacauaaauuaagacugauaaauccuacgggagugggggaacuuuauuuuucuaauucaguauuuuuuuuuuuuuuuuggagucauuuuaggcucuuaaacuagucaggcaaauucuggcuuaguaauucaacauuuuaaugagaguauuuucucuggcucagaaaugccaggagaguaugauaucucccuguguugggucaauucucagagaaaaaggggauacccuguguccugugccuugugaacuagccccacaguccuuuugacaguagaguaucaugcauagaauccagcuguugaaacaggccacagagugguggcuucugggaaggggccugucacauugucuagagguagcacaguuauagcccaagccaggaaggucagcugagccugggccaaggaguuccagaauaaaaucaggaaagaguuggcccugcuaaauaccucuaaguguagagucuggagaaggcuucaguuucccaccguccucacagucaucgguaguagaagacauagagccaguuucacgcgucauuuugugaaaugguuuuagcguauccuaaucuacugauuuucuuuaagccuagaacucuacuuaacuuguugucuguggucucugcuaggcauugcaugcagagauugcagguuauagaucucagacucuaaaucugaguauauagggagcaaguuugacaaaaauacuugcccauuugcuuucugugccaauuaaacuuauuucuuuacguguugggaaacucguuuguuucccuuaaaagaaccagguugacuuuguuauuuacagauaagauuuucuauaccaccugggaugagagcguuaaaaugcacuguuaccagguuagugccuuggauaaaggagauaaagaauuuuuuccacugcuugagaaauucagcaguuagaaaaacagugcauuccauucgugcaugcccgagcauuucaaugaagagacuuugucauagacaaacugacuggguuuauguaggcgaaaauguucaacuuuccguuggcuuucacauaauuuucaacaacugggugguuaaaauaugauuguuggugucugagugaaggcaugugcauucuuugaguguuuguaaugacugaugggauuaguaauuugguauucugagaauggaacucugugucuccccaaagaauagaguaagcgccauuggacuguucccguguggaauaaggcuguaagacacagcuuucauaauguaaugugcuaaaaaaaaaaacuucuauaggaagccacuacugugagaguucagaaguguguguguguguguguguguguguguacauauacccauuggaacauggugaacuguaaaauguucauauugccuuucauugaacauuuauucauaauuagcuguuucuaauuuguaucugauugcauuuaauaaaguucaagagacuugguuauuaaauuuaccugcauguuuaauuaggagaaauuuauugagcaauaguuuuucucugauuugaagucuucagagaaaguaauuuaaugaaaggguuuuuccaguaguaacugaauuacgcacaagagacuaagugcuguacucuggguggugucggcuugucagagaagcagauuagagcauuacuuuccuacuguugucagcccuggagauguauaacacucggugaaucuacggauuagaguuggcuuugucccucagguuuacaguauaauugccacugacacgugggagagguuuccacacugucagcaaguccuuacugaacacgcacgggccaugugucagacauaggaagagauggggucccacuacaugucucuuuucugugcuaucuaguaaauagucacgacuuaagggcaacauugacuuguuaguccagauaacucccccguugaaaugcaagacuauaauuuaaaguuauaccacuucagcaagcauaaaugucaaccccacccugguacaaaguucgcccacuaccuuauucccauucucagggggcaaaccuguuauuucagggcugagaaaaacguaccuguugccagucgcucacuuuccgcagucggcagucugggcugccuucuguacggcugaagcuuugugcccgauacguaccugugugagguccaaauaccaaaucacucugggcuccuguuuuuaccauuuuuaugucagcaacgggcucaggguccuguuaauucaaugcuaggauaccgcagaugaugauauuguugaacuucacauuguguaugcauaguaagaauguuauccauacuauagagaggauucaggagcuggguaugauggcauacgccuuuaagcauagcccuugggaggcugaggccggaggauggugaguaggagucccgccugcgauacauaguguuuucguguugagucucagcuauacagaaacaagagagaaagcaaaaauaaauaaauaggaggaaagagaacacguguauaauaaaaaauaaacguagccacaccggauagggaaggaaggaggagucuucaggcaggggcauucuggugaacgaaaaaugaaagaguaaaugggugacuagagagauucugagaauagccagggaaggcugcguuaggggagaacaggguggaauauggggucccuggcaugagaggagaggagagcagagaggauguugaucugaccggggcugagaacacuagugcaucucuugaacacugucuugcaacacuaaacauguugauucacuucuacauuugaggccuaggauguaugaacuuuuacgagcaaauaagauuucccuguggaaaaauaagauaaacacguguagaagaauggauaugaauguugccaaaugggcugcuuuccaaaacaggccucagaaagcuagggggcuugggagagauagagucacuugccagaaaggugagcaggugucaccuccuacccagccagucaaguuuggaaggugagaguaaugggcagguggacaaagagaagcaucugagguuuggugauugccugaggcacaaggauaaccuagaaucgagauucucccaaaugcagacaggccggaaauuagcgucugcgcagccuggcagaggccugggccaaggcucagcccagaccuucagggucuggagaagcccggggccuccucccuguuucaaacccaggcacugccuuggggcuuggacacagagccaggccaaccuaaugaaaaccagacuaugucuggccucaggaaaaaaaaaugucauggauuuuuggaaaauguauuuaaugaaggaaaugaauuugguagaggaaaugcuuacucuuaauggggagagagaggggcuugcuaauccuuggcuugacagaugacacuaaguaguuugcugguaguaaaacccagcaagaggagugugagaaaaguuuaguggcaggugacccgagcugggccaccaaguguucaucagggaagaacggaucccguucugggagugauguauagauguuuguuuauaagacagaaaagggauagcgaggaucagcgaagggguagaccccagagaccccccacggugcccaugcuccauccagaacauggagaguacguacuggucucuuaggaacucccaacccugugggguuuugaggcauugggggaaauauugaaucugcgugggcgagccugggaagguccgaggagaugccagcaaagcccaucugucguagcgguuugcuucucggcugcaucagugcgguugauguuuggaagcaaaaacagcuccuuguugccgagggaggccguugugcguggcguacgcuguuuuugucucuuggcugcuaucaucuacguggaagcaacgcuuccuccuuuccaagugcuguugacagccgagcucugccagaugucccccuggaagcaaaaucucuccuccuugagagucaccaacuacaugaucaagucagcuuggcaaagguuaagaagggaagauuguggacaucuugaaaacuccugaagggcggugggcuacagaaaacgguuucucgguccccuaacuucuuacaagaagaagcccucugaaaccccagcguaaaauuucuuagugaauuaagcauuucccuuguaaaguggugagugcugauaaaauugaugcauccagcagagaguuucagcauucuguuggaaaauccuucacugaauugcuauuuugagaggagagccaugugucucuacaacacauuuuucacuugagcagagagaggauuuuggcguuagucacaaaacaauauauuuuuuucuguucuuugcuuuucauauuugacagccaaaauucugaacgguuuaaauggguuaaaaaaaaaugaaauaaauugaaugucucauucaacuguugauauccccuucguuucuauuuaaauucaggguguaaguuuuaaauaucuguuucucugcuauuucuguuguccuuggcucuuuucuaauagguuucuuucucugacucuuuuuuuucuugcccuuccaggaaacauuggaaauucuuuuacaauugaccccaucuugggcucuauaaaaacugccagagaauuggaccgaagucaccaaguagauuaugauuuaaugguaaaagcuacagacaaaggcgauccaccuaugagcgagaugaccuccgugcguaucgcugucacuguugcugacaaugccucucccaaguucacauccaaagaguacucugcggagauuagugaagccaucaggauuggaaguuuuguugggauggucucugcacacagccagucaucagugauguaugaaauaagagacggaaacaugggcgacgcauuuaacauuaacccgcauuccggaagcaucaucacucagagagccuuggauuuugaaacacugcccauguauucauugacagugcaagggaccaacauggccgguuuguccaccaacacaacggugguggugcacgugcgggaugagaacgacaacccgcccguuuucacgcaggcagaauauucaggauucaucagcgagucagccuccgucaacaguguggugcugacagacaggaacguuccgcuggugauucgagcgacggaugcugacagggaauccaaugcucugcucgucuaucaaaucguugagccguccgugcacaacuauuuugcuauugaccccaccaccggcgccauccguacagugcugagucuggacuaugaagaaacacaugcuuuucacuucaccguccaagugcacgacauggggacuccucgucuguucgccgaguacgcagcgaaugugacugugcacgugaucgacaucaacgacugccccccugucuucucuaagucacuguacgaagugucucuucuccugccgacauacagaggcgugaacgucaucacggugaacgccacagacgcugacuccaaggcauucucccaggucauguacuccaucacugaaggcaacauuggggagaaguucucaauggaccacaagacuggcaccaucgcaauacagaacacgacucagcuacgaagccgcuaugagcugaccguccgcgccuccgacggcagguucacaagcauggccuccgugaaaaucaacguaaaggagagcagagagaguccccucaaguuuacccaagacgccuacuccgcaguugugaaagagaacuccacggaagccagaacguuagcugucaucacugcgauagggaacccacucaaugagccuuuguuuuaccgcauccucaacccagaccgcagauuuaaaaucagccacacgucgggcguguuguccaccaccgggauaccguuugaccgugagcaacaggagacguuugacguggugguagaggugacuaaggaacacgagccgucagcgguggcccacgucguggugaaagucaccgucgaagaccagaaugauaaugcuccaguguuuguuaaccuucccuacuacgcuguggugaagguggaugcugaggugggccacgucauucgcuauguuacugccauugacagagacaguggcagaaauggugacauacacuacuaccuuaaggagcaucaugaccacuuccagauuggaccuucuggcgacauuucucugaagaagcaguuugagcaugacacuuuaaauaaagaauaccuugucacaguggucgccaaggacggagggaguccagcuuucucugcagaaguucugguucccaucacugucaugaacaaagccaugcccguguuugaaaaggcuuucuauagcgcugagaucccagagaacauccagaugcacagcccagugguccauauccaagccaacagcccagaagggcugaaaguguucuacaguaucacggacggagacccuuuuagucaguuuacuauuaacuucaacacuggggugguaaacgucauagcaccacuggauuuugagucccacccagccuauaagcuaagcgugcgggcaacugacucccugacgggcgcucacgcugaaguguuuguugacaucauaguggaagacaucaaugauaacccuccuguguuugugcagccaucuuacuccacaacccugucugaagcaucuguaauuggaacaccuguccuucaaguucgagccacagauuccgacucggaaccaaacagaggaauuuccuaccagcugauuggaaaucacagcaaaagucacgaucauuuucacauagauaguaacacggggcucauuucacuagugagagcuuuggauuacgaacagucccagcagcacaggaucuucguaagggcuguugauggagggaugcccgcccugagcagugacguggucgucacuguggcugucaccgaccucaaugauaacccaccucuguuugaacaacagguuuaugaagccagaaucagcgagcacgccgcacacgggcauuucgugaugugugugagagccugcgaugcagacagcucagaccuagacaaguuagaguacucuauucugucuggcaaugaucauaaaagcuucaucaucgacagggaaacgggaauuaucacgcucuccaaccuccgccgccacacccugaagccguucuacagccucaacguuucggugucugaugggguuuuccggagcucggcucggguuaacguaacugugaugggagggaauuugcacaguccuguuuuucaccagaacgaauacgaaguggagcuagcugaaaacgcucccuugcacacccuggugguccaagugaaggcaucugacagagauucuggcauuuacagccacguaacuuaccacauuguaaaugacuuugccaaagacagguuuuaugugaaugacagagggcagauuuucacuuuggagaaacuugaccgagagacaccggcggagaaagugaucucgauccgcuugauggcuaaggaugcuggggggaagguugcuuucugcaccgucaaugucauccucacagacgacaaugacaacgcaccucaguuucgcucaaccaaguacgaggugaacaucggguccagcgcugccaaagggacgucggucgucaaggucuuugcgagugacgcugaugagggaucgaaugcugacgucaccuacgccauugaggcggauucugaaagugucaaggagaacuuggaaaucaacaagcugacuggccugauuacuacaaaggaaaguuuaauagguuuagagaaugaguucuucacuuucuucguuagagccguggauagcgggucuccgcccagagagucugucguuccugucuauauuaaaauacuuccaccagaagugcagcuuccuagguucucagagcccuuuuauaccuauaccaucucagaagacacgcccauuggaacagaaauugaccucauccggguagaacauggcggggcuguucuuuacauccuugucaaaggcaauacuccugagaguaaucgagaugaguucuuugugaucgacaggcagaaugggagacugaaacuggagaagagccuugaccaugagaccacuaagugguaucaguuuuccauccuggccagaugcacucuugaugacuacgaggugguggcuucuauagaugucaguauccaggugaaagaugcuaaugauaacagcccaguuuuggaguccagucccuaugaggcauuuauuguugaaaaccugccagggggaagcagggucauccagaucagagcaucugaccuagacucaggagccaacggccaagucauguacagccuagaccaaucccaagacgcagacaucaucgaaucuuuugccauuaacauggaaacaggcuggauuacaacucucaaggagcuugaccacgaagagagggccaguuaccagauuaaaguggucgcgucggaucacggugagaaggugcagcugucuuccaccgccauuguggguguuaccgucacugacgucaacgacagcccgccgagauucacggcugagauuuacaaagggacggugagugaggaugacccuccagguggcgugaucgccaucuuaagcacgaccgaugcugacacugaagagaucaacagacaggugucauacuucaucacagguaaaaugcucgggguucaguauaagaugaauccauauuacauguaacaugcuaaguguggacuuaugcaucugggagguugaugugauuuuaguugucuaaaaugaguagaaaucacguguaagccgaacuuaaaggacuuuaagcaaagcuguuucggccuagaauccucuaagauuuauucuuauacuuuauacuuagucuuguaaaugugaucuaaagaugcauugcaagcuacauuauggcuuuuuaaaguugacauucuuuaaucucauauuugaguagacauauuacggcugcuuugguuuauuuuuguuuuuguuuuuuuaaaguuaauauguaguaauauguguaaggacacacuuguaauucuagcucaaaggagcugaggcaggaggauucuguaaauuagagaccagcuuaaaauacaaaaccauaguacgaaaagcaaaagaaaaguauguaucaauuuuaaucauccuuuaaauagucuuaaucccucauaaacggcaaugccauacauucuuuguauaauguauuuuucccgugguuacaaaauucacuuuguaguccagcagcuuuggcagucaccuucuuuccuuaacuuccuaggaggggaugccuugggacaguuugcuguggaaaaugugcagagugacuggaggguguaugugaagaagccccucgacagggaacaaaaggauaguuaccuucugacugucacagcaacagacgggaccuucucuuccaaagcuagaguugaagucaaaguucucgaugccaacgacaacaguccagucugugagaagguaggcguguuccccuuaggaugguacgucacagauguaagucuccucaucuuuccagggggcagcuuuugaggugucauagcucccccauguuuuguguuaccauugcuuaccaaguugaaguggagaagcgucacaugggcaggauuugagaaagcgucaccaugacuuggcagcaugcuaugucggucaagaacuuuggucuaaaauauuggaaaauaaggggucucuuacacacacccagugucugacccuaaaaaacacucuggaagcuuucuaugaagauaaucucuucauuugccgauacaguuguuuuagggauggggaaacaucuggccagcagcuucuacuuguacaguacacguguguuaaugcacuauuuuaaggcauugguuguucauuccagagaaaccaugaggugauugaaaugacugcugcuacugcugggcucaguugagccuggggccauggaacugcagcaggcgagauggcugacuggaacugggugauaaaaaaccacccagcggccgagcugguuuagcccuaguaguuuaugaccaggaguauaacugcagggccucagccugugacgacugaaggcagguguggggagacuuuuuggguuuuuuuguuuuuuuugguuuuuuuuuuuuuuguuugccagcaguagaggaagucuuagccccgggaaggggaaccaggccaaguggugcacaccugcucucccaguguuuuggcugagaccggagaauuaccacauguucucagagaaguaaaccaaaccucauugucaggggaggcagcacuucugagaggggaacaguuaaucccaacauguauuuguguuuuuuaaugggaguauuuaaugacagcagugggcuauguaucucuucuuuuuuauauauguauauuauauaaaauauagauauauuuauauguuuuuauauacauauuuugauauauguauaguaucuauauuaaaucuuaccccauucauaauuuuuaauuauaccaacucugcccuagauaauacuuuaauuuggggacaucaccacuugaaauaaucacuguuacaaaguacccaguuuugugaacccuaaacuauaucuucccuacauuaaauucaucuuaggaaguaaguguaaaaggagcauaaucucuuucccuuauguguucuauuuauggcauggcuaaugugauaauuggaacuggaaccgaguguccaacagugugaggauucagacagaugugaagaaagaggaagcagacaugccugagccuuaccuagcccuggguuuuuuuuucccccaucccaugaagaccguuuaacuuguaauugcaguuauuuaauucucugugaggaacaguugguuguacacagucaaucccugcuccucaaauuaaguaaauguaauguaacagauauauauuuccucuaguuuuuacauaaauucgggcuauuacaucacauuuucucauaagaauuugaaugaaguaugaagcaguucaguagcauaucauauuuuauauccugaggguuacgugucaggcuggagucacggauguggggcugguaccuguuacaaggcucuuccuuguucccacaucuguuuuauaagaacaaucacuuuaaaagcucucugaguauuuaacuccaguccuuucccaugguuuccacggccagaaugagaugaugucuuuuccaucauccccucggccuucacugcugacacugaaugcuccuguuguuaacgguguuguuuaaugccuuguagaccucguauucugauaccauuccugaagacgcccuucccgggaagcuggucaugcaggucucugccacagacgcggauauccgguccaacgcagagauuacuuacacuuuauuugguucaggugcagagaaguuuaaacugaauccagacacagguaaggauggaauuugggacuaacuuaauaguguauuuccucugugugggagacaugagaucauguacaaaacuggaaauuacauuuuuucucuuuuaaauuuuauucugaugcuguggaaauggcaucuuagaaaucuaaacggcaacuuaauguguaaaaguugggaagagauaaaaaaacaggcagccauaguuaucaccuacuuggucuuuaagauugagaaauuaauauguuuucuuugaaaaaaaaauacucaggguguaucuaaacguuacuucuuuaauuugauggcguguugccuaaauuugcaauuuggcguuuucuauaaugaaaacgauccacauuuucuucaucuuuaagcuuuugaacuugguaagguaguuguuauuauuuuucuccaaauaagaguuguucagauuuuguaauuguagaagaaaaagaaagugauggaugauugcccuaagucuccaguguccccaucuguuucugccgucucuaggugaacugagaacacuagcccuccuugaucgugaggaacaagcaguuuauaaucuucuagucaaggccacggacggaggugggagguccugucaggcggcuauugugcucacguuagaagaugugaacgauaaugcuccugaguucaccgcggagcccuacaccaucacgguauucgagaacacagagccugggacaccgcugaccagagugcaggccacugaugcagacacagguauccugagggauggagaugcucuguccguggggugugcagaaggcuuugaguuccccgugauggaacacgccccauugaccucuuuuccucacgcacaugguggaacuuggccuuguugcagucaugauaaacuuaagccauuuuucauaaguguuuaaagucuugacaguuacaugcaguaaacuuccugcugcaguguagcugcggcgucucuaagguguuguuguugacgccauuaacugacacgccccgacacccauguugggguuugaaccugcgucuuucauaugcuuggcuaagcuuuguaccaguuuuauccccagccccucaaagugccuuuuugggaauaaaucaguagugcuguuaaggaaguuacagcaucgcaggaacauaacaagcuaguacuacauuccuaaaguuguauacauuuucaaacguauuugugaagaaaauaaguauauacauucaaacauuaugauaauagaggauaaaauaacuucuugauucauugauauugaagauauuuuuaaaagucaaccuuaauaauucuuuguugggugaaguuaauuaacaaauagauuucauuuuaguaagucuuauagauuccagcauaucagggauucgggacucaggggccccucuuccuagcugagaagguaucgacaaugauuggcuucugaaguggggagagccauuuuucuuaaggguguggucccugguuguucauguacaguuuugauggaugauucuaucccagugauuacagggcaguacaugcuggaguugguaaguuauuuauaaaagaaaagaaaaaaaagcauauagagguggaaggugugcagggguggaccuagggggagcuggaagcggggguacuugccacgaaaccugauaggauuauuucaugcuuugccaggauugaaucggaagauuuccuacucgcuggucgaauccgcugacgggcaguucuccauuaaugagagaucuggaauuauccaguuggaaaagcauuuggacagggaacuacaggcagucuauacucucacuuugaaagcaguggaccaaggauugccaaggagauugacagcuacuggcacggugguugugucuguuuuggauauaaacgacaacccgccaguguuugaguaccgugaauauggcgccagugugucugaggacauugucauugggacggagguucuccagguguacgccgcaagucgggauaucgaggccaacgcggaaaucaccuacgccaucauaaguggaaaugaacauggaaaauucagcaucgauucuaagacagguaacccucccugugaagugaggaagcccuuguuccauacugagggcugccuggcacuuccugcaauguggucgguggguguucugaagagguaacacucaggcuugcuuucucuuccugaguuggauuaaaaacaguuaggaagccgucagacucugauccugcauaauaccuacuuucuagcauauccaucauacauuacaagccaauuuggaaaacuauuagcucucacucagugucccagugucuuacucaggguuucuauucaugcacaaacaucaugaccaagaagcaaguuggggaggaaaggguuuauucagcuuacacuuuccauguugcuguucaucaccaaaggaagucagggcuggaacucaggcaggucaggaagcaggagcugaugcagaggccauggagggauguuccuuacuggcuugcuaucccuggcuugcucagccugcucucuuacagaacccaagggaugccuaaggaagcaaccacucauaaugggcccuccccuccuugaucacccccugagaaaaugcccugcugcuggaucucauggaggcauuuccucaagggaggcuccuuucucugugauaacuccagcuugugucaaguugacacacaaaaccagccagugcacccaggugugccaaggcaggaugcuuaguggugauaacauuguauaauuacucauuuaacccugauaucaaagguacauggaguggcuuccuccugacagauguuccuauacugaacaucuauuaauuccaucaguugacuucuuuacucauuacauacacgaguaaaaggagauuggguuccaaggagccagcagcguuaaagaucaaccauuacuaacuccugcuuugugacuaauacugguagccuguggucuaaaugcuuuugcacucucagaacauuguaaaaaguaacucuuucaggcugugcuuaguggugugugacuauuucugaugaagaauaggugucucaugacuuuuaauguaauuugauugucuuauauaauaucugugggacucuuggagcaauuauccuuucaaguaggauagacuaggucgagcagagucuucuuacaaguauuguuaaaucagugagggaucuuauuuuauuucuuuaauuguuuauugaaaccagaccucgguguguuguccagacagaucuuaugugcuuauucuuccugccccagccucccaacugcuaguauuagaagcacgcacgaucccaggguuccauucucagggggauauuuaacaagacuaagaggagaguuacuguauucuuuucagaagaacauucaugacaauaauaacaauaagaagggaaccgaaaggcacugaguugaauuuuuuuaaaaaaaguauuaaagucuguagugaaccacaucaaagaaggacuaagagccaccaucauuuaaaaagcauuauagucauuuaaagcagagagagcguuauugacuaaugccaccaggaauaugauacaaauaaaggaaauaaacagggauguuggguggguaaaaaaaaaucauaauuuuaaauuacugaauuaaagcugaagacguacaaguuacuuuuugcauugagaacuacauguguuaagaggcaucaucguuguaauaagaaauggagcugccgcgggcuggacguaauucugucuguccauacaggggccauauuuaucauugagagccuggauuaugaaagcucccacgaguauuaccugaccguggaagccacugauggaggcacgccuucguugagugauguggcgaccgugaacaucaacgucacagacaucaacgauaacagccccguguucagccaagacaccuacaccaccguggucagugaggaugcggcucucgagcagccugucauuacggugcgucucuucccucgcagcugccucugugggaucuugaaggggcgauuaguaaagucacucucauucuuaaacugguucucuuguaacuauguuagaggguugcaguuuuucagucagaggacauggcucaaggcuagagcacucacacuguccugucccgugaggauguuugagucuucacacugcaaaccaggaagcucuuugcucagucaaucaguggcuuuuaaguaacugccguaaauaagcuagcuguuauuaccucuguuguuuccuagauuauggcugacgaugcugauggccccucaaacagccacauccacuacuccauuauagaggggaaccagggaaguccguucacaauugacccugucagaggagaagugaaagugacgaagccccuagaccgggaaacgguaagccuaaaagggggacuuaaauugguaucaaagcacuaaagcuuccaguucauaccugcuugguauaaugugaaguccacaaaggguagaaccaucaucuuaggauaugcugagccaggauagaaguauuugaaagucaguuaaaguuuuggcucuccgggggcucuuuuuguuugguuaguuguuuuuguuuguuuguuugguugauguuuguuuguuuguuuguuguuguuuguuuuauugugacugucuuuuuuccuucauuauuugggaaucucacaucaugcacccuaaaccgcacuuacuucccaaacucaacucuccguccucucaugucugcuccccuucucccaccaaaaauaaccaaaaaaaccaaaacccagguagucagccuuguguugcccauguacucacuggacaaaccccuaguguccagccccacaagagaucagcagccuugccagaagccaucaacuguggagagccagggagaagugggccacacuuccgcucgagaggggcggagccagcucuuccacuggcuuacuauuuuugaguggcauguucuuaagagucugggagacuugacucuuaggcucagaagaaucuauuguacuccagagcaaaaugugauuuuuuuuuuuuuuaaaacauggaucuugcuauauaguucacgcuggacucaaauucacaguacccuugccucugauuucugcguguugaaaacucggggacgugucaaccauacuugacugaaauuuaguaauugucacuaaagaaccuagcucuuuuaacacccuuguauccacuguggccugauggaguucucaaggcuguguggucgagcauuggcuagacugaugucccacagaacggugcuccaggacuuagccaucuucccagcccagugcucgcucuaaagauacuguaacagggaacugcccuaacagggaagcugucucacuugacuugauuucuuuugcaaguggccacagauauuaccuugagggauuuaaauggcuaaguauagcccaagugugaaauugaaggugacggugaccuggcacgucuugagaugcuggaaaugagucugcacucggggugagacgcagcucaagucucuacccccugcucucuaagcuuuagccuuuguugaaggcgcucccugugggauuaccaaaguaacagccuuugagcuaggucagccguuugguuuccucuggucauuugcauaauuugucuuuguauucuaauagaacuguaagaguuucaagaucaaguacuuuaauaagaccugcauguaaugggagagagcagagaaucugcuucuugcugauaaccaucucuguugagaauagugcacccacucccucacugguugggaguuguuauuuuaauuuuaggaauuugcccagacaaaugacgucagugguucccgguugauuggcaccauucaggugacacguguuguucucucuuucccguggcaaagaucucagguuauacacucacggugcaagcugccgacaacggcaauccacccagagucaacacaaccacggugaauaucgaugucuccgaugucaaugacaacgcuccccucuucuccagagacaacuacagugucaucauccagguaaauggguggcgcacucagagggugugcggccuccuccaucucugacugacuccagacacucaugggacguagcuuuccuuuccagacccguuuucuagaaaacuguagaggagucuuaguauagaagagacguuuguaggacucagcucagcauuccucacuccaugcugugcuuugguuuaggaaagauauucucacuguccuaggaguaacuaggaagagcuuuuccuaauccugucuucuacugcacugguccacccccgcccucucuggucccucacuaacccccauggaugcuguuccauucccuugacucuucucagaucuccuuucuccuguuacuucucucaguccccauguuccugcccucuccgaucccucaugccucucuaccugucuucucucauccuugaugcacuagaaaugagguuuaauugucuguauauuuaccaggaagccucacaugucccugucuugauagcuuuuuguucuuuguuuauuacacaggagaacaaacccguggguuucagcguucugaagcugguagugacagacaaggacucuucccacaacgguccccccuucuucuucacuauugugaguggaaaugaugaaaacgccuuugaggugaaucagcaugggguccuccugacagcggcgacgaucaagaggaaagugaaggaccauuaccuucugcauguuaagguaccaaucaaagucuucaugguuucccuugggugcacagagagcauccacagguggccaucuuuguauauuuagauaguuuacucauaccuuacagaaaaccaaaaaagaauaugguuuguuuuuugagcucacgucugguuuugucuugguggcacuugggcuacuccuucccaagcaggagugugacucaguguccauaugaguaagggacaaaacaguuguccuuuuccucacugggcuucaugacaagaaaugaaugccuagcaguugauauaugggcagaccagaaguguacugcgucaugcauuuuuauuaggagauugcaguaacgccagaggcgacuucugucuuugcagguggcugacagcggaaagccucagcugucauccaugacacacauugacaucagggugaucgaggaaagcauccacccuccugccaucuugccgcuggagauuuucaucaccgccuuuggagaggaauacucagguggggucauaggaaagauccacgccaccgaccaggacguguaugacaccuugauguacagucuggauccccacauggauggccuguucucugucuccagcacggggggcaagcugauugcacacagaaagcuggacauaggccaguaccuucucaaugucagcgugacagaugggaaauucaccacgguggccgacaucaccgugcacauccaacaagugacccaggagaugcugaaccacaccgucgccauucgcuucgcgaaucucaccccggaggaguuuguuggugacuacuggcgcaacuuccagcgagcccuacgcaacauccugggcguccggaagaaugacauacagaucgucagccugcagcccuccgaaccccauucgcaucuggacgucuuacucuuugucgagaggucaggcggcacccacguuucaacaaagcaacuucugcauaagauuaauucuuccgugacggacguugaggaaaucauuggcgugaggauccuggaaguguuccagaagcucugugcggggcuggauugcccguggaaguucugugaugagaaggugucuguggaugaaaacgucauguccacucacagcacggccagacugaguuucgugacuccccgacaccacagaacagcagugugucucugcaaagguaauagcgccuauguauguggagaagagcgugaaagacugugguggggggcuuagcaguuaagaacccacugggcuacucuuccaugagccuuagguuugauuuccggcacccacauaguggcucaugaccaucuguaacuucagauccagggaugcccucuugugacuucaagggugucagguacccagguaguacauagacauacaugcagguaaaacacacauacauauuaaacuuuaaaaugguaggaggaggaggaggagaugaugaugauggugauggugaugaugaugaugaugauggugucagguauccagguaguacauagacauacaugcagguaaaacacacauacacauuaaacuuuaaaauguuaggaggaggaggaggaggaggaggaggagaugaugaugauggugauggugaugaugaugaugaugguggugguggugguggugaugaugaugaugaugauuuuauggccaggccuauggucucaucuguuuggaaguucaaaaccagccuaggcuacauagugaguccaggucagccugggcagcauaaugauaucucaucucaaaaugaaacaaugaaaaggggacuggagauacuguaagucaguggaugagugccagucuagcauacaggaggccugagagucaacccuccaacacucacaaaaaaaugaaugaaugaaugaaugaaugggaacaacaguagugaucauuuuccuaauuccuguguucucucuucucuuccucuugcuuuucuaaauaaagacgggacaugcccaccuguccaccaugggugugaagauaaccccugucccgcgggaucugagugugucgcggauccccgagaggagaaguauagcugcgugugccccgggggcggcuucgguaaaugcccagguaaacacucccaggaauuccaggaaaccacccucggcagugcuuugauaacuuucauuauuagagaaagaauuaugugcagguuauaucgagguaaggggagcgaugggcagagagcaggaccucacugagcuguugagcccucagccccgccccugccucggccaugccacgcccccgcccuggcccgccuccgccccgcccggagcagggguggggcuaggggguggggcaaugacugcauaaacuguggggcuucauaguuucuuguuucccucuaauccucuuuugccugauuucuccuacaguccucaguuucuugcuuuauuccccuacuuagcucauuaaagacauguuccaagcccauuguguguguguguaauccucacuguccuuaauaacuggacccagauuuagucaccauucuauauguguccuguuaaagaauguaucuuuccugcuaaaauauccuuucaaguucaucuuuauagguuggugcuuuucuccuuuuguuuaugauauuccaaaacuagaaucuacugucaaaaauuaaauacauuuaauuuuauuuuuuaagguauacugucauauuaguuuccaaaguaguugaacaaauaguuuccauuucuuccaggcauacauaaaggucuccugucuuauucucuuuuaucuguuuugaaagcuuucaauuaaaauccauacuuucucccuaguggaauugaaauacuuaacuuuuuuaauguuuuuggcugcuuauggaagaaggaaucacucugcuaauuaguuggugcuagcauuuccuauagugugucugcccucuugggcugucuguuucugaaugaguagaacccuggguauuauaauuaauaugcuuucuauugcaaucugcccuugcuucuuaguauuggacuucuauuuuguuaaaugugccuuuugucacuuugaaauugaauuuuuauuuagucaguucugcauaacuuaauuuucauuuccggaggcugauaggauuuucaucuucuuggaggaguggggauuguuuugugguuuugucugacagguuuugccuaaucaccuugaggcuacauuccuuuuuuuugcuuucccucaaauugccuacuaauaacuuacguggaacauuuuuauguuuauuuuuguuauuauuuuagacuuuauuucucuaauacagagcucuuagucucuuccucguggagagucagcugugugugcuaugcugucugugaaagccaauggacacuuuccccauugcugcgauuuuaaauuuaaaaaaacaaaagcaaaaacaaaccaaagucagccucuggggagggaaggcgaucgaucgaucauggucacugucgaugccaggcuuaaguuuggugcugauggaacuuuuuucugauauccguagggagcucaucuauaacuuucacgggaaacagcuucgugaaguaccgccugcuggagaaugagaacagacuggagaugaagcugagcaugcgucugagaaccuacuccucccacgcgguugucauguacgcgcgagggacugacuacagcauccuggagguauggcuucugcauccugugaccucagagcaagggacaccaugaaacuuaaauucuaucucguguccugacugucccgucuaaaaacaaacuaagaaaggugguuuuacugcgcaucucaagugccuggauaacguugacacuuggguguagucaaaaauucuuucugcuccccgcccgguagccuagaaauuuacuuuugauauuccuugagacacgugacagcuaacauucaagucucuucguuauaccuugcuaaucuuggcaguuuaaauggaaauucuacaugguauuguguguguugugugcguguguguaugcuguguggguucaguuagcaguuaauaacuagccacgucccuguuaguuuuggauguacacuuggcauuugggagcccccggacgauccauuuuuauuauucaugucguagaugaaugaguuuguggcaccuagaugcaagcuuguauucuuuuuaccuuuguucacuaaacaucccccucuuguauguagauuuugcacagacugaugcugaaggucauaugcgaucagugugaacgauauuuauucuguuguagauucauaccggaagacugcaguacaaauuugacugcggaagcggcccugggauugucuccguccagagcauucaggucaacgacgggcaguggcacgcggugucccuggaaguggagggcaauuacgccaagcugguucuggaugaaguccacaccgcuucgggcacagccccgggggcucugaaaacccucaaccuggacaacuacgucuuuuuugguggccaccuccgccagcaagggacaaagcaugggcgaggcgcccagguggccaguggcuucaggggcugcauggauucuauuuauuugaacgggcaggaguugccucugaacaacaagccaagagccuacgcgcacaucgaagaguggguggaccuaucucauggaugcuuauugaccgccacagaagacugcuccagcagccccugucagaauggaggcguuugcaaucccucgccuacuggagguaggcuucgugaagcugcagucgcucagaugguaccacaugcaugcacauguaggcaacucccaaauagcauugguuugccggcucccauucagugaugucaucgcuucuugucuuggucaccgauaagguggucaggacucaguggcuugugccauaacguuggucuggucucaggaaccaauguuuaccguguucuuuuccuccugcagcagugaccguggccaaagauaggcuagggccaggcccagcuuuuaagggagaaaaguaaacuaucuugccgcgucucuaacugcacaucgcugggaacacuacuuuugguaguaaaaccguuguugacugcuguugcuuaguguauguccaccaaugggccuuuuucuccugcccuuuccauuugacccaccagccauauauaauuuucauuaccuaaaucuagucacaaaacauacuaaauuuuaaaauaauucuaaaaggcucccaaauccagaacuuucugaccccccuccccaauguauuauuuaaauuucuaggguuagaagcauuugaauaucagauuuccaguuuagaaauguuccagcuguaaaaucuauaggaaauacuccuaaaccuaaaaaacaaaaacaaaucaaacaacaacaacaacaacaaaacaaccaaccaaaaaaccccacaacccuccagagucgggaucauuucuggucccaguauuuuagaaaagagguuucgaccccauagauaacucugcaccuggagagaaugggaaguuuacuccguuucguagcuguuggggcaccguaucuucacuuaagcauaaagcuguaagcacguaaaaccccuugcggucacugagugacugggucuucucuucuuuuccacgguguagguuauuacugcaagugcagcgcguuguacguagggacguucugugaggugagcgucaacccgugcuccuccaaccccugccucuacggaggaacgugcaugguagacaacggcggcuuugugugccagugcagggggcuguacacuggucagagguauguuuguaucucuuucuuagugacuuguaaggugaaauguuaaagcauggaauucugcaccggauugggccaccguguucuucguuguuaaugcugucuguuuuuuacucgcagugaacucaugagggcuuguuuuguuuuuuucuuuuugcauguguuuuuccuuauuuagaugucagcuuaguccguacugcaaagaugaucccuguaagaaugguggaacguguuuugacaguuuggauggugcugucugucagugugacucaggcuuuaggggagaaagguaaaugguuucuuugaagcuucguuucugcugcgcccuuuccacagugugccgaccguuaacucacaccgcauccggucaggacauggugauucucauuggcauuuuuuaugauguacagacgaaagucuugagacaaaagacuggaucaaagcuugccagugugggucuuuggcaaguagcaaaugcuuguaagcugguugcauuucuuccugauuuucgaagguacucaucaugguuucucacacaguguuuuguaccaacauagauccagcaucuugcugggcaguuacaguaacuauacuaauuauuauuauauuaaguauacuaauccccagaauaagccuaagaggugguuaggauuuagauauuuagacauuuagaucucucaaaaaacauacaccuauauaucuugaggaaaaaaaugcauaagaaacuaguuucagaugcugucgcuucaaaaguuacugaaaucaggcucagacacacucccagcacucaguugguagaggccgguggaucugaguuuuucaggccagcauggucuacauaguucuagcacaaucagagcacucagaaaauauccaaaaaugggaaccagaagaggccuuuuguggauuaguuacauggucauaggcugauuugggagccaaccauaucaagccauaaugauaagacccugucucaacagcagagcuacuggguacacguaauauuuaaaugcuuagcaaaggacauucaggagagcaccccucggucucauuaggcugcuggugcggucugccuguauuuauucuauauuguuuuguccuuggagucauuauaauccugaauuuugcccuuaguucugcggcccugguacauuuguggauuuccccaauuuuaaucaguguauuuaucaagaauauaucaguguucagucuuuauuauaauuguucauaauuugcaaguaaaugauuuuuuuuucaaaugggaaagagccucagaagcgaggguggcaguguaaaagccacaugguccccgugccccuguuuagaaaagcagaaggaacugucuguggucuauucuguaauguugacaugcguaagaagaggacucuaauucccgaaggaaucgcguuuuuaaauggagagcauuuucuauucccucaugggucuuccaggaccguccuaaucccaaaaggaccauuuucacugaaauucaaccuggccuaggagaaggguuugcagcacacaccacuuguuaaaauguaccuuagcuuuuaaaauugcuaaauaaaugauagcuugauugugaaaccugagaacagccuauguuuuaaccuauugaacugguucaguuaucuauuaauucuggaaaaaugcagcuagauauuugcuugaugugguuggcucccagauacccauucagccuaugaccauguaacuaacccacaaaaggccucuucugguucccguuuuuuggaucuuuucugauuguuucccauccagcuuuguuuuggcaucucuuaugaaggauggguauguuuaguguucauccugaagaauucuaggacaggugccgucugacauguacuacaaaggucucucuuccuucuuggcagaugucagagugacaucgaugagugugcugggaaccccugucggaacggggcccuuugcgagaacacacacggcuccuaucacuguaacugcagccaggaguacagagggaagcacugugaggaugccucucccaaccacuacguguccaccccguggaacaucggacuggccgagggaauagguauuauuguguuuauagcugggauagucuuacuagugaugguguucguccucugccggaagaugaucagucggaagaagaagcgccaggcugaaccugaagacaaacguuuggggccaaccacggcuuucuugcagagaccuuauuuugauucaaagcugaacaagaacauuuacuccgacaucccgccccaggugccgguccgucccauuuccuacacucccagcauuccaagcgacucgagaaacaaccuugaccgcaauuccuucgaaggcuccgcgaucccagagcauccagaauucagcaccuucaaccccgagucuaugcacgggcaucgaaaagccguggcugugugcagcguagcuccaaacuugccuccaccgccgccuuccaacucgcccucagacagcgacuccauacagaagccuagcugggacuuugacuacgacgguaagggugugauguuuucuaucucgccagugcugcagaaguggucuuggcugaggugguuugcggggaugaggaugaaugacgcuuuccaaucugaaaugguccugaaaacucauuugcauauuccaguuacuggcuggggauugggagcuuuaaauuauuuuuauucaauuagaucuaguuauguucuaauuaauauucuagauguaacugauacacacuaucaacuuugauuuggggguguuuuauuauaacaagagaaauaaugguggggucacuaagauacuaauuuuuuuauuauuuguugaaucuguugagcauaugugcagaucuuucuauuguuuuguuucuaggaugcuccucuagcucgccccuccuccccucacguguaagggcagauacuuucuuacuaaguguagccaugagucuuagggaacuuggaacucaccuguuuaccugccaucucucccuuucagcuaaagugguagaucuggaucccugucucucuaagaagccccuggaggaaaagcccucccagccauacagugcccgggagagccugucugaggugcagucgcuuagcuccuuccagucagaguccugugaugacaaugguagguuucagaugcugaccuuggacgcuguggccgcuuugaagugcugcugucauuccuuaggcuguauaccaacguauagacacauauaucauagauaguccggguucccuaauuaaguaugaaaacgucccaugucccccuugguguaaaugaacacugugguaugaguacuugcaugaaccuacacaggggaaauauuuaaagguagcucaggcauagggcacuugccuagcaugcacagggguacugucaaauaaaacaauguucuuacucaagaguuguuuuaacuauaguaauaggaaagaaaaaaaauguuaauuuuccuuguuuggcuacucugguauuauuuauauuuuuuuugcauaacaguaaguguuacggaagcuuuguggguuuuuuuucaagaucucuguaacaguuuuucugaaccaugcagugcacacucauaacaugcagcacccucugagaaaagauauguagaaaucugaaauguucaccuuuggucauaccuucgguauuacaagguuuuauuugucucuuccccaaccaccgcugccccagcucccauuuggaucagagcguucugacugagagcagaguuuaagagacggcuaguaagucggauuauauuucuaacaaagaagguuuggcagcggguucuaugacuccaguucuguguaucuggugucccccaggguggauggcgcugauagacagcuucgccguauuagcacguguacaaaaaaauuaccagccccacgauagugguuaucgacuggaaauaauugaaucucagauaguaugggcuccauuuuuaauuuuucuccucguguaaaacugcaguguguuuacacauuaagaguauuuuaucauuggaaagaagaaacuugcuaauaacuaccacuuccaaaauaacaugauccaugaccagagugauguaaaauuuauaaugacuacaucuauggaucucugcaucugcuuaucuauaaaaauuugcagagcccuuuucuuuauuaaagaugacuauaaauauguccuguucuucaaagauuucaagcauguuuuucauuacuuauagcacacccuuguuuauucuuguguagagaauauggauuuauuauugcuuaucaucaagaacaaaccaggauuauuuuuccccuuaguuucaauccuaaaauguuuguuuugccagcuuaaaugauuuaugcuuuggcccuuguaaguucagugcuguucaaaaaaugcauuuaagaauuuugucaauaauuuuucauuuucuuuuuuuuuuuuuaauuuaaauuguugaaaucccauucuuaacaacauucagacacucuggagaagucauugucagauuaguuacaaagcuaauuuuugggcaguagcagcgugaggcaaagccugcgagggacuguccgugguuuuaaucccuacaucagucagucagucauuuucagucacagacuucaagucugagccacgucugcacaaaucauuucaucggcaguuuucuacgccuuuuuaguggcuagccauacacuugacggcucaagagagcacagacgggucucgugugguucuguaguuugggaggcugcuacgucucagggcugaaguucaggugucaauggggccugccucgcugaaagcucugagggaaguuuugguuuccuucuuucucccgugccuaaaauucacucacguuccugguaauuaaggccucguuucauucccuguucagaaccuguggccagaaugccaagcucuacagggucacagcugggacagcucccugugacaggccauuccuguccccucagcucacccagcuaaugcagggcgaucgcuccauuucccccucaugagagccuuagugacagcaggaagcuugucuuguucuguuuucuucugugcauuagguuaaauagccuuuaggucucaggauuagaguguacccaguuaacaugcacguuuauguugauguugguacuuugaaauaauaugcaaaugacaaaagcaaucuguacggcgucugcgacaugagaaauacacgcuaagcaacagggacacaaccagucuuguaguuaugucucccuagauuuccuuauuuucaaacaaccaguuccuugaacauauaaccguuuguccaggagacgcaaaccugaauugcuuuccccccugauauacuccauaacuguaauuguauaaaauacuugacuaaagcuuuuucccuagcuuuuacuaaaacuugguuauuucauucauuugacuaauaguggcaagccuauagcuugauuugaagugucuugagaccuguaacuaauugguuaguuagugcaagggucucgcauaauuaucuagucucaaauuucacaguuuaggggagaaauugcauugaguuacagaauuuuacuuaaugcacuguuuucuacuaacgaaggauuuuccuaacuggcuccuuuugugccuuuuuacaagcuuccauagugacuguaauacaccuugucaacgcugucguugacacggugaauaaagaagguauaagugucuguguuuucugucugugguuugcagugacuguaagugggguggugugagucugccuauuguccuguuauuaaaauaguucauccauugggaagguuugguggcuuucauuuugggacauuuauguucacaguacuagugcauugugaaaauaucuguaugcaugucuuuucguuacuuguuuuaaauguuaugggucacuguugaagacucggggcugguuuccagcuccaguuucugacugaguaauuguauugagccugaggacuuuuguuuugaauaaauguccaguugauuuggaucuagaaaucuccuaaugugaaaaucagugcuuucaaauaacuuaccuagaccaucaagagcacacacacaggguuagagagauggcccaguggauaaagugcuuggcacacaggugugaggaccaucgcucagaucccagggacucauauaaaucaguggcucggugaucuacugauaauuccugccuuggaaggccgaggcaagcuuaagcuggagaaagggaggcugaggaugagucucgguguccaccgugggcuuccacaugcacacauacaugcacacgcacacauguacauacacacauacaugcauaugcacuguggccccugcccccgccacccgugaaaacagagaagugcaaacuguauucacacagcaucagcaguaaacacgcacgacucuucugcaaggacacaucagcaggcgcauuuagguggaagaggcaagguuaucugcuagauugcgaggaggacaaguaugacuucaguggucacagcuacuaaaggacucgaucuguuuucuuaaaaguaccguguuuucacuuugagcaucagaauguuauccauauuuugucuacccaguuuuagcugaaacaggaugacaucccaauaucuuaaauauugauaaguuuaaagaagcagaaauuuaaagucuucuccaugugauuucuacugauuuaucuucuuaucugaagugaauuuaaagugggaaaugcaccuaaguuuagaggguuuucaaaugcuuaguguccaacaaagguugccaggccucguuuauaaaggaauuuaguguauuauagaagauguauaaaaagcaccagagauaacuucccuaaauacuccuuuuauucauauuuuugaaacaucugucuuuuccacuuuuauuuaaacuccuaucagagguaucagucagcuauuaguuugucagaaauuacuucauugucaucguuuucaaagacauuaugggaugcauagagagcauuaugggaugcauagagagcauucuguuuagaaaaguggccacaguucuacugugacugacugcuccucuuaccgugauggugacauaccugcugggucacacuugacccacguugucuucaauaaucugugagauuuucgucucauuucuuauagaaaaccaaucugaaccuuagucaggcugagcaucccaugguccugagugcuuucuauccauuuccuuggacuuggggccagaggucuguguguaauguggucacugggagagagaguacaguugcagaguugaugggaagaggccaugccaugaaguaguuaauucgggagcucacuagagaaaggguuaacaguauaaauagaaaaaucauagugaacgugaguaagguguugggauauggucaacuuuugguugucugugagcgugugacaccaguuucuccgaacuuauacuuuugaagguucuucugugcgcuacuguguguguaaaucguguagcucguguuuuuagaucgucccuuaaguaaccaauuaauuuauuaauuuauuuaauaauacauaauuuuuuaucaguaucuguaguuuauuauuuuccugagucagguguuucccuggaaacacacagcaaagccgcuaguuuaucaucucuuaucuccuccuucuugccauaucccaucuaguuugagcaucaugauuuucucauuugugaucauuagccgagagugagguaaagacagcguguccguauauuguaccaugugcuuaucuggguugccgucucagccaagucugucaauuuuaauuaucgcuguuuucuuuuucuuucuacucugccaccaaaagaaucuuuggcugcuccugaccucagcaaaccaagaggugacuuaugcaugccagcuguccauuaauaaucacuggaagucauugggaaagcucgacccaaugaugacaggcuucuccgggugcuugaugcuaccgcaguaacuaaaccccuuguugugcacugccuuguaauacggaucaccuaaccuucucccggcucucaaaacagaaacuccuacccuuaaguuaggccuugguuuucuuuaaagaaaacaacaaccaaaaggggggggggggcuuuucauacuuuaaaaugguaacaaagauuguuauagcuuaucauaauuauuugguuauauuuuguuugauuuagggacuugguuugcugcauagccgguauuaaaauaauucauuguucuauucauugcuaaugaggccaaugaaaccacugcugccuuuacuacugaguuuaacauguuaaaagcuauuuuuauuacuuuuagauuugccuuaauuaguauuuuuuuggauggcaggcagcacaaagcccagugauguuuggaauuucccccaguagagaccuucugcuugaaagccccuuacuaacuuccuauaccgccuuccuauggaacagggucagcaguuacagaaggaaaguugaagcgugguuaggauuguuugaaaaaagaaaaaacaaaacaaaacaaaaaaccugcauguauuuuaagugguucagcugcuucugucggaacucuauugccuugaaugucagauauguacuaaaacccucaaguucacauuccggaaauagucacuaugucggggcgggguuugcagagcgauggccuugggaugaaugcacaccuacuucugugucuugugucugauacucugagcucucuccccgaggcauagaagcuaagaaaaacaaacugaaaucguguuuccuuuucuaccaaggguaccacugggauacaucagacuggaugccaagugucccucugccagacauacaagaguuccccaauuacgaggcuauugacgaacacacaccccucuacucggcugauccaaacgccaucgauacugacuauuacccuggggguuaugacauugaaagugacuuuccacccccaccagaggacuucccugcacccgaugaacugccaccauugccuccagaguucagcgaccaguucgaguccauacacccacccagggacaugccugcagcagguagcuugggaucuuccucccggagucggcagagguucaaccugaaucaguaccugcccaauuucuaccccgccgauauguccgaaccucagaaacaaggcgcuggcgagaacaguccauguagagaacccuacacccccuaccccccaggguaucaaagaaacuucgaagcgcccaccauagaaaacaugcccauguccguguacgccucgacggcuuccugcuccgacgugucagcgugcugugaaguggagucugaggucaugaugagcgacuacgagagcggggacgacggccacuucgaagaggugacgaucccuccgcuagauucccagcagcauacggaagugugacgcucaaacuccuccccaaagugccuggacuuucaugaaccuagagaugcuaucggugacauccgccguuguguuguucuuuugcagccgucugggccgcuucucggugagccgcgguaggcguggcugcacggagucacaagccucuugacauguuagccauuuccagcguccuaacugacuguaaucgaccggguuuucauccccugucccauccccugagcaucuuuucguauuuagauuugucucuguuaaaaugaugaaacggaaaucgguccugucgucuuguuagcaugauucauguauuuauauagauccgauuauuuuaauuuuugcuuucuuuguguaaauuuuauguacagauuugauuuuuuguuuuuuuuuguuuguuuguuuguuuuccccccucuccuaguuuuuaccuagguuuucaggacgccucguguuuuuguuuucugcuggaucuguguggugguguuagcgucguuugccuagcaucugauuuucugauguaaccaggguuucacgcuguucuuuuccucugaaguaugacauuucauugacacauuucgguccaguguagcuguacauaugggguguggacgaccuguuacuggacaugucuuauuaaauggguugcuguauuaggauuauaaacauuuuucauuauuggaaagugugaaggggaccuucugcauaccuguuuagaaccaaaaccaccacgacacgguuuuuauagugucuguauauuugugaugcaauggucuuguaaagguuuuuacugaaaacuaucauuagccagccuuucuuacugacaauaaauuauuaauaaaauacuuuagcuuuaa

SEQ ID NO: 12420 - RNA, 102051 nt, Mus musculus
uuaaagcuaaaguauuuuauuaauaauuuauugucaguaagaaaggcuggcuaaugauaguuuucaguaaaaaccuuuacaagaccauugcaucacaaauauacagacacuauaaaaaccgugucguggugguuuugguucuaaacagguaugcagaagguccccuucacacuuuccaauaaugaaaaauguuuauaauccuaauacagcaacccauuuaauaagacauguccaguaacaggucguccacaccccauauguacagcuacacuggaccgaaaugugucaaugaaaugucauacuucagaggaaaagaacagcgugaaacccugguuacaucagaaaaucagaugcuaggcaaacgacgcuaacaccaccacacagauccagcagaaaacaaaaacacgaggcguccugaaaaccuagguaaaaacuaggagaggggggaaaacaaacaaacaaacaaaaaaaaacaaaaaaucaaaucuguacauaaaauuuacacaaagaaagcaaaaauuaaaauaaucggaucuauauaaauacaugaaucaugcuaacaagacgacaggaccgauuuccguuucaucauuuuaacagagacaaaucuaaauacgaaaagaugcucaggggaugggacaggggaugaaaacccggucgauuacagucaguuaggacgcuggaaauggcuaacaugucaagaggcuugugacuccgugcagccacgccuaccgcggcucaccgagaagcggcccagacggcugcaaaagaacaacacaacggcggaugucaccgauagcaucucuagguucaugaaaguccaggcacuuuggggaggaguuugagcgucacacuuccguaugcugcugggaaucuagcggagggaucgucaccucuucgaaguggccgucguccccgcucucguagucgcucaucaugaccucagacuccacuucacagcacgcugacacgucggagcaggaagccgucgaggcguacacggacaugggcauguuuucuauggugggcgcuucgaaguuucuuugauacccugggggguaggggguguaggguucucuacauggacuguucucgccagcgccuuguuucugagguucggacauaucggcgggguagaaauugggcagguacugauucagguugaaccucugccgacuccgggaggaagaucccaagcuaccugcugcaggcaugucccuggguggguguauggacucgaacuggucgcugaacucuggaggcaaugguggcaguucaucgggugcagggaaguccucugguggggguggaaagucacuuucaaugucauaacccccaggguaauagucaguaucgauggcguuuggaucagccgaguagagggguguguguucgucaauagccucguaauuggggaacucuuguaugucuggcagagggacacuuggcauccagucugauguaucccagugguacccuugguagaaaaggaaacacgauuucaguuuguuuuucuuagcuucuaugccucggggagagagcucagaguaucagacacaagacacagaaguaggugugcauucaucccaaggccaucgcucugcaaaccccgccccgacauagugacuauuuccggaaugugaacuugaggguuuuaguacauaucugacauucaaggcaauagaguuccgacagaagcagcugaaccacuuaaaauacaugcagguuuuuuguuuuguuuuguuuuuucuuuuuucaaacaauccuaaccacgcuucaacuuuccuucuguaacugcugacccuguuccauaggaaggcgguauaggaaguuaguaaggggcuuucaagcagaaggucucuacugggggaaauuccaaacaucacugggcuuugugcugccugccauccaaaaaaauacuaauuaaggcaaaucuaaaaguaauaaaaauagcuuuuaacauguuaaacucaguaguaaaggcagcagugguuucauuggccucauuagcaaugaauagaacaaugaauuauuuuaauaccggcuaugcagcaaaccaagucccuaaaucaaacaaaauauaaccaaauaauuaugauaagcuauaacaaucuuuguuaccauuuuaaaguaugaaaagccccccccccccuuuugguuguuguuuucuuuaaagaaaaccaaggccuaacuuaaggguaggaguuucuguuuugagagccgggagaagguuaggugauccguauuacaaggcagugcacaacaagggguuuaguuacugcgguagcaucaagcacccggagaagccugucaucauugggucgagcuuucccaaugacuuccagugauuauuaauggacagcuggcaugcauaagucaccucuugguuugcugaggucaggagcagccaaagauucuuuugguggcagaguagaaagaaaaagaaaacagcgauaauuaaaauugacagacuuggcugagacggcaacccagauaagcacaugguacaauauacggacacgcugucuuuaccucacucucggcuaaugaucacaaaugagaaaaucaugaugcucaaacuagaugggauauggcaagaaggaggagauaagagaugauaaacuagcggcuuugcuguguguuuccagggaaacaccugacucaggaaaauaauaaacuacagauacugauaaaaaauuauguauuauuaaauaaauuaauaaauuaauugguuacuuaagggacgaucuaaaaacacgagcuacacgauuuacacacacaguagcgcacagaagaaccuucaaaaguauaaguucggagaaacuggugucacacgcucacagacaaccaaaaguugaccauaucccaacaccuuacucacguucacuaugauuuuucuauuuauacuguuaacccuuucucuagugagcucccgaauuaacuacuucauggcauggccucuucccaucaacucugcaacuguacucucucucccagugaccacauuacacacagaccucuggccccaaguccaaggaaauggauagaaagcacucaggaccaugggaugcucagccugacuaagguucagauugguuuucuauaagaaaugagacgaaaaucucacagauuauugaagacaacgugggucaagugugacccagcagguaugucaccaucacgguaagaggagcagucagucacaguagaacuguggccacuuuucuaaacagaaugcucucuaugcaucccauaaugcucucuaugcaucccauaaugucuuugaaaacgaugacaaugaaguaauuucugacaaacuaauagcugacugauaccucugauaggaguuuaaauaaaaguggaaaagacagauguuucaaaaauaugaauaaaaggaguauuuagggaaguuaucucuggugcuuuuuauacaucuucuauaauacacuaaauuccuuuauaaacgaggccuggcaaccuuuguuggacacuaagcauuugaaaacccucuaaacuuaggugcauuucccacuuuaaauucacuucagauaagaagauaaaucaguagaaaucacauggagaagacuuuaaauuucugcuucuuuaaacuuaucaauauuuaagauauugggaugucauccuguuucagcuaaaacuggguagacaaaauauggauaacauucugaugcucaaagugaaaacacgguacuuuuaagaaaacagaucgaguccuuuaguagcugugaccacugaagucauacuuguccuccucgcaaucuagcagauaaccuugccucuuccaccuaaaugcgccugcugauguguccuugcagaagagucgugcguguuuacugcugaugcugugugaauacaguuugcacuucucuguuuucacggguggcgggggcaggggccacagugcauaugcauguauguguguauguacaugugugcgugugcauguaugugugcauguggaagcccacgguggacaccgagacucauccucagccucccuuucuccagcuuaagcuugccucggccuuccaaggcaggaauuaucaguagaucaccgagccacugauuuauaugagucccugggaucugagcgaugguccucacaccugugugccaagcacuuuauccacugggccaucucucuaacccugugugugugcucuugauggucuagguaaguuauuugaaagcacugauuuucacauuaggagauuucuagauccaaaucaacuggacauuuauucaaaacaaaaguccucaggcucaauacaauuacucagucagaaacuggagcuggaaaccagccccgagucuucaacagugacccauaacauuuaaaacaaguaacgaaaagacaugcauacagauauuuucacaaugcacuaguacugugaacauaaaugucccaaaaugaaagccaccaaaccuucccaauggaugaacuauuuuaauaacaggacaauaggcagacucacaccaccccacuuacagucacugcaaaccacagacagaaaacacagacacuuauaccuucuuuauucaccgugucaacgacagcguugacaagguguauuacagucacuauggaagcuuguaaaaaggcacaaaaggagccaguuaggaaaauccuucguuaguagaaaacagugcauuaaguaaaauucuguaacucaaugcaauuucuccccuaaacugugaaauuugagacuagauaauuaugcgagacccuugcacuaacuaaccaauuaguuacaggucucaagacacuucaaaucaagcuauaggcuugccacuauuagucaaaugaaugaaauaaccaaguuuuaguaaaagcuagggaaaaagcuuuagucaaguauuuuauacaauuacaguuauggaguauaucaggggggaaagcaauucagguuugcgucuccuggacaaacgguuauauguucaaggaacugguuguuugaaaauaaggaaaucuagggagacauaacuacaagacugguugugucccuguugcuuagcguguauuucucaugucgcagacgccguacagauugcuuuugucauuugcauauuauuucaaaguaccaacaucaacauaaacgugcauguuaacuggguacacucuaauccugagaccuaaaggcuauuuaaccuaaugcacagaagaaaacagaacaagacaagcuuccugcugucacuaaggcucucaugagggggaaauggagcgaucgcccugcauuagcugggugagcugaggggacaggaauggccugucacagggagcugucccagcugugacccuguagagcuuggcauucuggccacagguucugaacagggaaugaaacgaggccuuaauuaccaggaacgugagugaauuuuaggcacgggagaaagaaggaaaccaaaacuucccucagagcuuucagcgaggcaggccccauugacaccugaacuucagcccugagacguagcagccucccaaacuacagaaccacacgagacccgucugugcucucuugagccgucaaguguauggcuagccacuaaaaaggcguagaaaacugccgaugaaaugauuugugcagacguggcucagacuugaagucugugacugaaaaugacugacugacugauguagggauuaaaaccacggacagucccucgcaggcuuugccucacgcugcuacugcccaaaaauuagcuuuguaacuaaucugacaaugacuucuccagagugucugaauguuguuaagaaugggauuucaacaauuuaaauuaaaaaaaaaaaaagaaaaugaaaaauuauugacaaaauucuuaaaugcauuuuuugaacagcacugaacuuacaagggccaaagcauaaaucauuuaagcuggcaaaacaaacauuuuaggauugaaacuaaggggaaaaauaauccugguuuguucuugaugauaagcaauaauaaauccauauucucuacacaagaauaaacaagggugugcuauaaguaaugaaaaacaugcuugaaaucuuugaagaacaggacauauuuauagucaucuuuaauaaagaaaagggcucugcaaauuuuuauagauaagcagaugcagagauccauagauguagucauuauaaauuuuacaucacucuggucauggaucauguuauuuuggaagugguaguuauuagcaaguuucuucuuuccaaugauaaaauacucuuaauguguaaacacacugcaguuuuacacgaggagaaaaauuaaaaauggagcccauacuaucugagauucaauuauuuccagucgauaaccacuaucguggggcugguaauuuuuuuguacacgugcuaauacggcgaagcugucuaucagcgccauccacccugggggacaccagauacacagaacuggagucauagaacccgcugccaaaccuucuuuguuagaaauauaauccgacuuacuagccgucucuuaaacucugcucucagucagaacgcucugauccaaaugggagcuggggcagcggugguuggggaagagacaaauaaaaccuuguaauaccgaagguaugaccaaaggugaacauuucagauuucuacauaucuuuucucagagggugcugcauguuaugagugugcacugcaugguucagaaaaacuguuacagagaucuugaaaaaaaacccacaaagcuuccguaacacuuacuguuaugcaaaaaaaauauaaauaauaccagaguagccaaacaaggaaaauuaacauuuuuuuucuuuccuauuacuauaguuaaaacaacucuugaguaagaacauuguuuuauuugacaguaccccugugcaugcuaggcaagugcccuaugccugagcuaccuuuaaauauuuccccuguguagguucaugcaaguacucauaccacaguguucauuuacaccaagggggacaugggacguuuucauacuuaauuagggaacccggacuaucuaugauauaugugucuauacguugguauacagccuaaggaaugacagcagcacuucaaagcggccacagcguccaaggucagcaucugaaaccuaccauugucaucacaggacucugacuggaaggagcuaagcgacugcaccucagacaggcucucccgggcacuguauggcugggagggcuuuuccuccaggggcuucuuagagagacagggauccagaucuaccacuuuagcugaaagggagagauggcagguaaacaggugaguuccaaguucccuaagacucauggcuacacuuaguaagaaaguaucugcccuuacacgugaggggaggaggggcgagcuagaggagcauccuagaaacaaaacaauagaaagaucugcacauaugcucaacagauucaacaaauaauaaaaaaauuaguaucuuagugaccccaccauuauuucucuuguuauaauaaaacacccccaaaucaaaguugauaguguguaucaguuacaucuagaauauuaauuagaacauaacuagaucuaauugaauaaaaauaauuuaaagcucccaauccccagccaguaacuggaauaugcaaaugaguuuucaggaccauuucagauuggaaagcgucauucauccucauccccgcaaaccaccucagccaagaccacuucugcagcacuggcgagauagaaaacaucacacccuuaccgucguagucaaagucccagcuaggcuucuguauggagucgcugucugagggcgaguuggaaggcggcgguggaggcaaguuuggagcuacgcugcacacagccacggcuuuucgaugcccgugcauagacucgggguugaaggugcugaauucuggaugcucugggaucgcggagccuucgaaggaauugcggucaagguuguuucucgagucgcuuggaaugcugggaguguaggaaaugggacggaccggcaccuggggcgggaugucggaguaaauguucuuguucagcuuugaaucaaaauaaggucucugcaagaaagccgugguuggccccaaacguuugucuucagguucagccuggcgcuucuucuuccgacugaucaucuuccggcagaggacgaacaccaucacuaguaagacuaucccagcuauaaacacaauaauaccuauucccucggccaguccgauguuccacgggguggacacguagugguugggagaggcauccucacagugcuucccucuguacuccuggcugcaguuacagugauaggagccguguguguucucgcaaagggccccguuccgacagggguucccagcacacucaucgaugucacucugacaucugccaagaaggaagagagaccuuuguaguacaugucagacggcaccuguccuagaauucuucaggaugaacacuaaacauacccauccuucauaagagaugccaaaacaaagcuggaugggaaacaaucagaaaagauccaaaaaacgggaaccagaagaggccuuuuguggguuaguuacauggucauaggcugaauggguaucugggagccaaccacaucaagcaaauaucuagcugcauuuuuccagaauuaauagauaacugaaccaguucaauagguuaaaacauaggcuguucucagguuucacaaucaagcuaucauuuauuuagcaauuuuaaaagcuaagguacauuuuaacaaguggugugugcugcaaacccuucuccuaggccagguugaauuucagugaaaaugguccuuuugggauuaggacgguccuggaagacccaugagggaauagaaaaugcucuccauuuaaaaacgcgauuccuucgggaauuagaguccucuucuuacgcaugucaacauuacagaauagaccacagacaguuccuucugcuuuucuaaacaggggcacggggaccauguggcuuuuacacugccacccucgcuucugaggcucuuucccauuugaaaaaaaaaucauuuacuugcaaauuaugaacaauuauaauaaagacugaacacugauauauucuugauaaauacacugauuaaaauuggggaaauccacaaauguaccagggccgcagaacuaagggcaaaauucaggauuauaaugacuccaaggacaaaacaauauagaauaaauacaggcagaccgcaccagcagccuaaugagaccgaggggugcucuccugaauguccuuugcuaagcauuuaaauauuacguguacccaguagcucugcuguugagacagggucuuaucauuauggcuugauaugguuggcucccaaaucagccuaugaccauguaacuaauccacaaaaggccucuucugguucccauuuuuggauauuuucugagugcucugauugugcuagaacuauguagaccaugcuggccugaaaaacucagauccaccggccucuaccaacugagugcugggagugugucugagccugauuucaguaacuuuugaagcgacagcaucugaaacuaguuucuuaugcauuuuuuuccucaagauauauagguguauguuuuuugagagaucuaaaugucuaaauaucuaaauccuaaccaccucuuaggcuuauucuggggauuaguauacuuaauauaauaauaauuaguauaguuacuguaacugcccagcaagaugcuggaucuauguugguacaaaacacugugugagaaaccaugaugaguaccuucgaaaaucaggaagaaaugcaaccagcuuacaagcauuugcuacuugccaaagacccacacuggcaagcuuugauccagucuuuugucucaagacuuucgucuguacaucauaaaaaaugccaaugagaaucaccauguccugaccggaugcggugugaguuaacggucggcacacuguggaaagggcgcagcagaaacgaagcuucaaagaaaccauuuaccuuucuccccuaaagccugagucacacugacagacagcaccauccaaacugucaaaacacguuccaccauucuuacagggaucaucuuugcaguacggacuaagcugacaucuaaauaaggaaaaacacaugcaaaaagaaaaaaacaaaacaagcccucaugaguucacugcgaguaaaaaacagacagcauuaacaacgaagaacacgguggcccaauccggugcagaauuccaugcuuuaacauuucaccuuacaagucacuaagaaagagauacaaacauaccucugaccaguguacagcccccugcacuggcacacaaagccgccguugucuaccaugcacguuccuccguagaggcagggguuggaggagcacggguugacgcucaccucacagaacgucccuacguacaacgcgcugcacuugcaguaauaaccuacaccguggaaaagaagagaagacccagucacucagugaccgcaagggguuuuacgugcuuacagcuuuaugcuuaagugaagauacggugccccaacagcuacgaaacggaguaaacuucccauucucuccaggugcagaguuaucuauggggucgaaaccucuuuucuaaaauacugggaccagaaaugaucccgacucuggaggguugugggguuuuuugguugguuguuuuguuguuguuguuguuguuugauuuguuuuuguuuuuuagguuuaggaguauuuccuauagauuuuacagcuggaacauuucuaaacuggaaaucugauauucaaaugcuucuaacccuagaaauuuaaauaauacauuggggaggggggucagaaaguucuggauuugggagccuuuuagaauuauuuuaaaauuuaguauguuuugugacuagauuuagguaaugaaaauuauauauggcuggugggucaaauggaaagggcaggagaaaaaggcccauugguggacauacacuaagcaacagcagucaacaacgguuuuacuaccaaaaguaguguucccagcgaugugcaguuagagacgcggcaagauaguuuacuuuucucccuuaaaagcugggccuggcccuagccuaucuuuggccacggucacugcugcaggaggaaaagaacacgguaaacauugguuccugagaccagaccaacguuauggcacaagccacugaguccugaccaccuuaucggugaccaagacaagaagcgaugacaucacugaaugggagccggcaaaccaaugcuauuugggaguugccuacaugugcaugcaugugguaccaucugagcgacugcagcuucacgaagccuaccuccaguaggcgagggauugcaaacgccuccauucugacaggggcugcuggagcagucuucuguggcggucaauaagcauccaugagauagguccacccacucuucgaugugcgcguaggcucuuggcuuguuguucagaggcaacuccugcccguucaaauaaauagaauccaugcagccccugaagccacuggccaccugggcgccucgcccaugcuuugucccuugcuggcggagguggccaccaaaaaagacguaguuguccagguugaggguuuucagagcccccggggcugugcccgaagcgguguggacuucauccagaaccagcuuggcguaauugcccuccacuuccagggacaccgcgugccacugcccgucguugaccugaaugcucuggacggagacaaucccagggccgcuuccgcagucaaauuuguacugcagucuuccgguaugaaucuacaacagaauaaauaucguucacacugaucgcauaugaccuucagcaucagucugugcaaaaucuacauacaagagggggauguuuagugaacaaagguaaaaagaauacaagcuugcaucuaggugccacaaacucauucaucuacgacaugaauaauaaaaauggaucguccgggggcucccaaaugccaaguguacauccaaaacuaacagggacguggcuaguuauuaacugcuaacugaacccacacagcauacacacacgcacacaacacacacaauaccauguagaauuuccauuuaaacugccaagauuagcaagguauaacgaagagacuugaauguuagcugucacgugucucaaggaauaucaaaaguaaauuucuaggcuaccgggcggggagcagaaagaauuuuugacuacacccaagugucaacguuauccaggcacuugagaugcgcaguaaaaccaccuuucuuaguuuguuuuuagacgggacagucaggacacgagauagaauuuaaguuucauggugucccuugcucugaggucacaggaugcagaagccauaccuccaggaugcuguagucagucccucgcgcguacaugacaaccgcgugggaggaguagguucucagacgcaugcucagcuucaucuccagucuguucucauucuccagcaggcgguacuucacgaagcuguuucccgugaaaguuauagaugagcucccuacggauaucagaaaaaaguuccaucagcaccaaacuuaagccuggcaucgacagugaccaugaucgaucgaucgccuucccuccccagaggcugacuuugguuuguuuuugcuuuuguuuuuuuaaauuuaaaaucgcagcaauggggaaaguguccauuggcuuucacagacagcauagcacacacagcugacucuccacgaggaagagacuaagagcucuguauuagagaaauaaagucuaaaauaauaacaaaaauaaacauaaaaauguuccacguaaguuauuaguaggcaauuugagggaaagcaaaaaaaaggaauguagccucaaggugauuaggcaaaaccugucagacaaaaccacaaaacaauccccacuccuccaagaagaugaaaauccuaucagccuccggaaaugaaaauuaaguuaugcagaacugacuaaauaaaaauucaauuucaaagugacaaaaggcacauuuaacaaaauagaaguccaauacuaagaagcaagggcagauugcaauagaaagcauauuaauuauaauacccaggguucuacucauucagaaacagacagcccaagagggcagacacacuauaggaaaugcuagcaccaacuaauuagcagagugauuccuucuuccauaagcagccaaaaacauuaaaaaaguuaaguauuucaauuccacuagggagaaaguauggauuuuaauugaaagcuuucaaaacagauaaaagagaauaagacaggagaccuuuauguaugccuggaagaaauggaaacuauuuguucaacuacuuuggaaacuaauaugacaguauaccuuaaaaaauaaaauuaaauguauuuaauuuuugacaguagauucuaguuuuggaauaucauaaacaaaaggagaaaagcaccaaccuauaaagaugaacuugaaaggauauuuuagcaggaaagauacauucuuuaacaggacacauauagaauggugacuaaaucuggguccaguuauuaaggacagugaggauuacacacacacacaaugggcuuggaacaugucuuuaaugagcuaaguaggggaauaaagcaagaaacugaggacuguaggagaaaucaggcaaaagaggauuagagggaaacaagaaacuaugaagccccacaguuuaugcagucauugccccacccccuagccccaccccugcuccgggcggggcggaggcgggccagggcgggggcguggcauggccgaggcaggggcggggcugagggcucaacagcucagugagguccugcucucugcccaucgcuccccuuaccucgauauaaccugcacauaauucuuucucuaauaaugaaaguuaucaaagcacugccgagggugguuuccuggaauuccugggaguguuuaccugggcauuuaccgaagccgcccccggggcacacgcagcuauacuucuccucucggggauccgcgacacacucagaucccgcgggacagggguuaucuucacacccaugguggacaggugggcaugucccgucuuuauuuagaaaagcaagaggaagagaagagagaacacaggaauuaggaaaaugaucacuacuguuguucccauucauucauucauucauucauuuuuuugugaguguuggaggguugacucucaggccuccuguaugcuagacuggcacucauccacugacuuacaguaucuccaguccccuuuucauuguuucauuuugagaugagauaucauuaugcugcccaggcugaccuggacucacuauguagccuaggcugguuuugaacuuccaaacagaugagaccauaggccuggccauaaaaucaucaucaucaucaucaccaccaccaccaccaccaucaucaucaucaucaccaucaccaucaucaucaucuccuccuccuccuccuccuccuccuccuaacauuuuaaaguuuaauguguauguguguuuuaccugcauguaugucuauguacuaccuggauaccugacaccaucaucaucaucaucaucaccaucaccaucaucaucaucuccuccuccuccuccuaccauuuuaaaguuuaauauguauguguguuuuaccugcauguaugucuauguacuaccuggguaccugacacccuugaagucacaagagggcaucccuggaucugaaguuacagauggucaugagccacuaugugggugccggaaaucaaaccuaaggcucauggaagaguagcccaguggguucuuaacugcuaagccccccaccacagucuuucacgcucuucuccacauacauaggcgcuauuaccuuugcagagacacacugcuguucuguggugucggggagucacgaaacucagucuggccgugcugugaguggacaugacguuuucauccacagacaccuucucaucacagaacuuccacgggcaauccagccccgcacagagcuucuggaacacuuccaggauccucacgccaaugauuuccucaacguccgucacggaagaauuaaucuuaugcagaaguugcuuuguugaaacgugggugccgccugaccucucgacaaagaguaagacguccagaugcgaaugggguucggagggcugcaggcugacgaucuguaugucauucuuccggacgcccaggauguugcguagggcucgcuggaaguugcgccaguagucaccaacaaacuccuccggggugagauucgcgaagcgaauggcgacggugugguucagcaucuccugggucacuuguuggaugugcacggugaugucggccaccguggugaauuucccaucugucacgcugacauugagaagguacuggccuauguccagcuuucugugugcaaucagcuugccccccgugcuggagacagagaacaggccauccauguggggauccagacuguacaucaaggugucauacacguccuggucgguggcguggaucuuuccuaugaccccaccugaguauuccucuccaaaggcggugaugaaaaucuccagcggcaagauggcaggaggguggaugcuuuccucgaucacccugaugucaaugugugucauggaugacagcugaggcuuuccgcugucagccaccugcaaagacagaagucgccucuggcguuacugcaaucuccuaauaaaaaugcaugacgcaguacacuucuggucugcccauauaucaacugcuaggcauucauuucuugucaugaagcccagugaggaaaaggacaacuguuuugucccuuacucauauggacacugagucacacuccugcuugggaaggaguagcccaagugccaccaagacaaaaccagacgugagcucaaaaaacaaaccauauucuuuuuugguuuucuguaagguaugaguaaacuaucuaaauauacaaagauggccaccuguggaugcucucugugcacccaagggaaaccaugaagacuuugauugguaccuuaacaugcagaagguaaugguccuucacuuuccucuugaucgucgccgcugucaggaggaccccaugcugauucaccucaaaggcguuuucaucauuuccacucacaauagugaagaagaaggggggaccguugugggaagaguccuugucugucacuaccagcuucagaacgcugaaacccacggguuuguucuccuguguaauaaacaaagaacaaaaagcuaucaagacagggacaugugaggcuuccugguaaauauacagacaauuaaaccucauuucuagugcaucaaggaugagagaagacagguagagaggcaugagggaucggagagggcaggaacauggggacugagagaaguaacaggagaaaggagaucugagaagagucaagggaauggaacagcauccauggggguuagugagggaccagagagggcggggguggaccagugcaguagaagacaggauuaggaaaagcucuuccuaguuacuccuaggacagugagaauaucuuuccuaaaccaaagcacagcauggagugaggaaugcugagcugaguccuacaaacgucucuucuauacuaagacuccucuacaguuuucuagaaaacgggucuggaaaggaaagcuacgucccaugagugucuggagucagucagagauggaggaggccgcacacccucugagugcgccacccauuuaccuggaugaugacacuguaguugucucuggagaagaggggagcguugucauugacaucggagacaucgauauucaccgugguuguguugacucuggguggauugccguugucggcagcuugcaccgugaguguauaaccugagaucuuugccacgggaaagagagaacaacacgugucaccugaauggugccaaucaaccgggaaccacugacgucauuugucugggcaaauuccuaaaauuaaaauaacaacucccaaccagugagggagugggugcacuauucucaacagagaugguuaucagcaagaagcagauucucugcucucucccauuacaugcaggucuuauuaaaguacuugaucuugaaacucuuacaguucuauuagaauacaaagacaaauuaugcaaaugaccagaggaaaccaaacggcugaccuagcucaaaggcuguuacuuugguaaucccacagggagcgccuucaacaaaggcuaaagcuuagagagcaggggguagagacuugagcugcgucucaccccgagugcagacucauuuccagcaucucaagacgugccaggucaccgucaccuucaauuucacacuugggcuauacuuagccauuuaaaucccucaagguaauaucuguggccacuugcaaaagaaaucaagucaagugagacagcuucccuguuagggcaguucccuguuacaguaucuuuagagcgagcacugggcugggaagauggcuaaguccuggagcaccguucugugggacaucagucuagccaaugcucgaccacacagccuugagaacuccaucaggccacaguggauacaaggguguuaaaagagcuagguucuuuagugacaauuacuaaauuucagucaaguaugguugacacguccccgaguuuucaacacgcagaaaucagaggcaaggguacugugaauuugaguccagcgugaacuauauagcaagauccauguuuuaaaaaaaaaaaaaaucacauuuugcucuggaguacaauagauucuucugagccuaagagucaagucucccagacucuuaagaacaugccacucaaaaauaguaagccaguggaagagcuggcuccgccccucucgagcggaaguguggcccacuucucccuggcucuccacaguugauggcuucuggcaaggcugcugaucucuuguggggcuggacacuagggguuuguccagugaguacaugggcaacacaaggcugacuaccuggguuuugguuuuuuugguuauuuuuggugggagaaggggagcagacaugagaggacggagaguugaguuugggaaguaagugcgguuuagggugcaugaugugagauucccaaauaaugaaggaaaaaagacagucacaauaaaacaaacaacaacaaacaaacaaacaaacaucaaccaaacaaacaaacaaaaacaacuaaccaaacaaaaagagcccccggagagccaaaacuuuaacugacuuucaaauacuucuauccuggcucagcauauccuaagaugaugguucuacccuuuguggacuucacauuauaccaagcagguaugaacuggaagcuuuagugcuuugauaccaauuuaagucccccuuuuaggcuuaccguuucccggucuaggggcuucgucacuuucacuucuccucugacagggucaauugugaacggacuucccugguuccccucuauaauggaguaguggauguggcuguuugaggggccaucagcaucgucagccauaaucuaggaaacaacagagguaauaacagcuagcuuauuuacggcaguuacuuaaaagccacugauugacugagcaaagagcuuccugguuugcagugugaagacucaaacauccucacgggacaggacagugugagugcucuagccuugagccauguccucugacugaaaaacugcaacccucuaacauaguuacaagagaaccaguuuaagaaugagagugacuuuacuaaucgccccuucaagaucccacagaggcagcugcgagggaagagacgcaccguaaugacaggcugcucgagagccgcauccucacugaccacggugguguaggugucuuggcugaacacggggcuguuaucguugaugucugugacguugauguucacggucgccacaucacucaacgaaggcgugccuccaucaguggcuuccacggucagguaauacucgugggagcuuucauaauccaggcucucaaugauaaauauggccccuguauggacagacagaauuacguccagcccgcggcagcuccauuucuuauuacaacgaugaugccucuuaacacauguaguucucaaugcaaaaaguaacuuguacgucuucagcuuuaauucaguaauuuaaaauuaugauuuuuuuuuacccacccaacaucccuguuuauuuccuuuauuuguaucauauuccugguggcauuagucaauaacgcucucucugcuuuaaaugacuauaaugcuuuuuaaaugaugguggcucuuaguccuucuuugaugugguucacuacagacuuuaauacuuuuuuuaaaaaaauucaacucagugccuuucgguucccuucuuauuguuauuauugucaugaauguucuucugaaaagaauacaguaacucuccucuuagucuuguuaaauaucccccugagaauggaacccugggaucgugcgugcuucuaauacuagcaguugggaggcuggggcaggaagaauaagcacauaagaucugucuggacaacacaccgaggucugguuucaauaaacaauuaaagaaauaaaauaagaucccucacugauuuaacaauacuuguaagaagacucugcucgaccuagucuauccuacuugaaaggauaauugcuccaagagucccacagauauuauauaagacaaucaaauuacauuaaaagucaugagacaccuauucuucaucagaaauagucacacaccacuaagcacagccugaaagaguuacuuuuuacaauguucugagagugcaaaagcauuuagaccacaggcuaccaguauuagucacaaagcaggaguuaguaaugguugaucuuuaacgcugcuggcuccuuggaacccaaucuccuuuuacucguguauguaaugaguaaagaagucaacugauggaauuaauagauguucaguauaggaacaucugucaggaggaagccacuccauguaccuuugauaucaggguuaaaugaguaauuauacaauguuaucaccacuaagcauccugccuuggcacaccugggugcacuggcugguuuugugugucaacuugacacaagcuggaguuaucacagagaaaggagccucccuugaggaaaugccuccaugagauccagcagcagggcauuuucucagggggugaucaaggaggggagggcccauuaugagugguugcuuccuuaggcaucccuuggguucuguaagagagcaggcugagcaagccagggauagcaagccaguaaggaacaucccuccauggccucugcaucagcuccugcuuccugaccugccugaguuccagcccugacuuccuuuggugaugaacagcaacauggaaaguguaagcugaauaaacccuuuccuccccaacuugcuucuuggucaugauguuugugcaugaauagaaacccugaguaagacacugggacacugagugagagcuaauaguuuuccaaauuggcuuguaauguaugauggauaugcuagaaaguagguauuaugcaggaucagagucugacggcuuccuaacuguuuuuaauccaacucaggaagagaaagcaagccugaguguuaccucuucagaacacccaccgaccacauugcaggaagugccaggcagcccucaguauggaacaagggcuuccucacuucacagggaggguuaccugucuuagaaucgaugcugaauuuuccauguucauuuccacuuaugauggcguaggugauuuccgcguuggccucgauaucccgacuugcggcguacaccuggagaaccuccgucccaaugacaauguccucagacacacuggcgccauauucacgguacucaaacacuggcggguugucguuuauauccaaaacagacacaaccaccgugccaguagcugucaaucuccuuggcaauccuugguccacugcuuucaaagugagaguauagacugccuguaguucccuguccaaaugcuuuuccaacuggauaauuccagaucucucauuaauggagaacugcccgucagcggauucgaccagcgaguaggaaaucuuccgauucaauccuggcaaagcaugaaauaauccuaucagguuucguggcaaguacccccgcuuccagcucccccuagguccaccccugcacaccuuccaccucuauaugcuuuuuuuucuuuucuuuuauaaauaacuuaccaacuccagcauguacugcccuguaaucacugggauagaaucauccaucaaaacuguacaugaacaaccagggaccacacccuuaagaaaaauggcucuccccacuucagaagccaaucauugucgauaccuucucagcuaggaagaggggccccugagucccgaaucccugauaugcuggaaucuauaagacuuacuaaaaugaaaucuauuuguuaauuaacuucacccaacaaagaauuauuaagguugacuuuuaaaaauaucuucaauaucaaugaaucaagaaguuauuuuauccucuauuaucauaauguuugaauguauauacuuauuuucuucacaaauacguuugaaaauguauacaacuuuaggaauguaguacuagcuuguuauguuccugcgaugcuguaacuuccuuaacagcacuacugauuuauucccaaaaaggcacuuugaggggcuggggauaaaacugguacaaagcuuagccaagcauaugaaagacgcagguucaaaccccaacaugggugucggggcgugucaguuaauggcgucaacaacaacaccuuagagacgccgcagcuacacugcagcaggaaguuuacugcauguaacugucaagacuuuaaacacuuaugaaaaauggcuuaaguuuaucaugacugcaacaaggccaaguuccaccaugugcgugaggaaaagaggucaauggggcguguuccaucacggggaacucaaagccuucugcacaccccacggacagagcaucuccaucccucaggauaccugugucugcaucaguggccugcacucuggucagcggugucccaggcucuguguucucgaauaccgugaugguguagggcuccgcggugaacucaggagcauuaucguucacaucuucuaacgugagcacaauagccgccugacaggaccucccaccuccguccguggccuugacuagaagauuauaaacugcuuguuccucacgaucaaggagggcuaguguucucaguucaccuagagacggcagaaacagauggggacacuggagacuuagggcaaucauccaucacuuucuuuuucuucuacaauuacaaaaucugaacaacucuuauuuggagaaaaauaauaacaacuaccuuaccaaguucaaaagcuuaaagaugaagaaaauguggaucguuuucauuauagaaaacgccaaauugcaaauuuaggcaacacgccaucaaauuaaagaaguaacguuuagauacacccugaguauuuuuuuuucaaagaaaacauauuaauuucucaaucuuaaagaccaaguaggugauaacuauggcugccuguuuuuuuaucucuucccaacuuuuacacauuaaguugccguuuagauuucuaagaugccauuuccacagcaucagaauaaaauuuaaaagagaaaaaauguaauuuccaguuuuguacaugaucucaugucucccacacagaggaaauacacuauuaaguuagucccaaauuccauccuuaccugugucuggauucaguuuaaacuucucugcaccugaaccaaauaaaguguaaguaaucucugcguuggaccggauauccgcgucuguggcagagaccugcaugaccagcuucccgggaagggcgucuucaggaaugguaucagaauacgaggucuacaaggcauuaaacaacaccguuaacaacaggagcauucagugucagcagugaaggccgaggggaugauggaaaagacaucaucucauucuggccguggaaaccaugggaaaggacuggaguuaaauacucagagagcuuuuaaagugauuguucuuauaaaacagaugugggaacaaggaagagccuuguaacagguaccagccccacauccgugacuccagccugacacguaacccucaggauauaaaauaugauaugcuacugaacugcuucauacuucauucaaauucuuaugagaaaaugugauguaauagcccgaauuuauguaaaaacuagaggaaauauauaucuguuacauuacauuuacuuaauuugaggagcagggauugacuguguacaaccaacuguuccucacagagaauuaaauaacugcaauuacaaguuaaacggucuucaugggaugggggaaaaaaaaacccagggcuagguaaggcucaggcaugucugcuuccucuuucuucacaucugucugaauccucacacuguuggacacucgguuccaguuccaauuaucacauuagccaugccauaaauagaacacauaagggaaagagauuaugcuccuuuuacacuuacuuccuaagaugaauuuaauguagggaagauauaguuuaggguucacaaaacuggguacuuuguaacagugauuauuucaaguggugauguccccaaauuaaaguauuaucuagggcagaguugguauaauuaaaaauuaugaaugggguaagauuuaauauagauacuauacauauaucaaaauauguauauaaaaacauauaaauauaucuauauuuuauauaauauacauauauaaaaaagaagagauacauagcccacugcugucauuaaauacucccauuaaaaaacacaaauacauguugggauuaacuguuccccucucagaagugcugccuccccugacaaugagguuugguuuacuucucugagaacaugugguaauucuccggucucagccaaaacacugggagagcaggugugcaccacuuggccugguuccccuucccggggcuaagacuuccucuacugcuggcaaacaaaaaaaaaaaaaaccaaaaaaaacaaaaaaacccaaaaagucuccccacaccugccuucagucgucacaggcugaggcccugcaguuauacuccuggucauaaacuacuagggcuaaaccagcucggccgcugggugguuuuuuaucacccaguuccagucagccaucucgccugcugcaguuccauggccccaggcucaacugagcccagcaguagcagcagucauuucaaucaccucaugguuucucuggaaugaacaaccaaugccuuaaaauagugcauuaacacacguguacuguacaaguagaagcugcuggccagauguuuccccaucccuaaaacaacuguaucggcaaaugaagagauuaucuucauagaaagcuuccagaguguuuuuuagggucagacacuggguguguguaagagaccccuuauuuuccaauauuuuagaccaaaguucuugaccgacauagcaugcugccaagucauggugacgcuuucucaaauccugcccaugugacgcuucuccacuucaacuugguaagcaaugguaacacaaaacaugggggagcuaugacaccucaaaagcugcccccuggaaagaugaggagacuuacaucugugacguaccauccuaaggggaacacgccuaccuucucacagacuggacuguugucguuggcaucgagaacuuugacuucaacucuagcuuuggaagagaaggucccgucuguugcugugacagucagaagguaacuauccuuuuguucccugucgaggggcuucuucacauacacccuccagucacucugcacauuuuccacagcaaacugucccaaggcauccccuccuaggaaguuaaggaaagaaggugacugccaaagcugcuggacuacaaagugaauuuuguaaccacgggaaaaauacauuauacaaagaauguauggcauugccguuuaugagggauuaagacuauuuaaaggaugauuaaaauugauacauacuuuucuuuugcuuuucguacuaugguuuuguauuuuaagcuggucucuaauuuacagaauccuccugccucagcuccuuugagcuagaauuacaaguguguccuuacacauauuacuacauauuaacuuuaaaaaaacaaaaacaaaaauaaaccaaagcagccguaauaugucuacucaaauaugagauuaaagaaugucaacuuuaaaaagccauaauguagcuugcaaugcaucuuuagaucacauuuacaagacuaaguauaaaguauaagaauaaaucuuagaggauucuaggccgaaacagcuuugcuuaaaguccuuuaaguucggcuuacacgugauuucuacucauuuuagacaacuaaaaucacaucaaccucccagaugcauaaguccacacuuagcauguuacauguaauauggauucaucuuauacugaaccccgagcauuuuaccugugaugaaguaugacaccugucuguugaucucuucagugucagcaucggucgugcuuaagauggcgaucacgccaccuggagggucauccucacucaccgucccuuuguaaaucucagccgugaaucucggcgggcugucguugacgucagugacgguaacacccacaauggcgguggaagacagcugcaccuucucaccgugauccgacgcgaccacuuuaaucugguaacuggcccucucuucguggucaagcuccuugagaguuguaauccagccuguuuccauguuaauggcaaaagauucgaugaugucugcgucuugggauuggucuaggcuguacaugacuuggccguuggcuccugagucuaggucagaugcucugaucuggaugacccugcuucccccuggcagguuuucaacaauaaaugccucauagggacuggacuccaaaacugggcuguuaucauuagcaucuuucaccuggauacugacaucuauagaagccaccaccucguagucaucaagagugcaucuggccaggauggaaaacugauaccacuuaguggucucauggucaaggcucuucuccaguuucagucucccauucugccugucgaucacaaagaacucaucucgauuacucucaggaguauugccuuugacaaggauguaaagaacagccccgccauguucuacccggaugaggucaauuucuguuccaaugggcgugucuucugagaugguauagguauaaaagggcucugagaaccuaggaagcugcacuucugguggaaguauuuuaauauagacaggaacgacagacucucugggcggagacccgcuauccacggcucuaacgaagaaagugaagaacucauucucuaaaccuauuaaacuuuccuuuguaguaaucaggccagucagcuuguugauuuccaaguucuccuugacacuuucagaauccgccucaauggcguaggugacgucagcauucgaucccucaucagcgucacucgcaaagaccuugacgaccgacgucccuuuggcagcgcuggacccgauguucaccucguacuugguugagcgaaacugaggugcguugucauugucgucugugaggaugacauugacggugcagaaagcaaccuuccccccagcauccuuagccaucaagcggaucgagaucacuuucuccgccggugucucucggucaaguuucuccaaagugaaaaucugcccucugucauucacauaaaaccugucuuuggcaaagucauuuacaaugugguaaguuacguggcuguaaaugccagaaucucugucagaugccuucacuuggaccaccagggugugcaagggagcguuuucagcuagcuccacuucguauucguucuggugaaaaacaggacugugcaaauucccucccaucacaguuacguuaacccgagccgagcuccggaaaaccccaucagacaccgaaacguugaggcuguagaacggcuucaggguguggcggcggagguuggagagcgugauaauucccguuucccugucgaugaugaagcuuuuaugaucauugccagacagaauagaguacucuaacuugucuaggucugagcugucugcaucgcaggcucucacacacaucacgaaaugcccgugugcggcgugcucgcugauucuggcuucauaaaccuguuguucaaacagagguggguuaucauugaggucggugacagccacagugacgaccacgucacugcucagggcgggcaucccuccaucaacagcccuuacgaagauccugugcugcugggacuguucguaauccaaagcucucacuagugaaaugagccccguguuacuaucuaugugaaaaugaucgugacuuuugcugugauuuccaaucagcugguaggaaauuccucuguuugguuccgagucggaaucuguggcucgaacuugaaggacagguguuccaauuacagaugcuucagacaggguuguggaguaagauggcugcacaaacacaggaggguuaucauugaugucuuccacuaugaugucaacaaacacuucagcgugagcgcccgucagggagucaguugcccgcacgcuuagcuuauaggcugggugggacucaaaauccaguggugcuaugacguuuaccaccccaguguugaaguuaauaguaaacugacuaaaagggucuccguccgugauacuguagaacacuuucagcccuucugggcuguuggcuuggauauggaccacugggcugugcaucuggauguucucugggaucucagcgcuauagaaagccuuuucaaacacgggcauggcuuuguucaugacagugaugggaaccagaacuucugcagagaaagcuggacucccuccguccuuggcgaccacugugacaagguauucuuuauuuaaagugucaugcucaaacugcuucuucagagaaaugucgccagaagguccaaucuggaaguggucaugaugcuccuuaagguaguaguguaugucaccauuucugccacugucucugucaauggcaguaacauagcgaaugacguggcccaccucagcauccaccuucaccacagcguaguagggaagguuaacaaacacuggagcauuaucauucuggucuucgacggugacuuucaccacgacgugggccaccgcugacggcucguguuccuuagucaccucuaccaccacgucaaacgucuccuguugcucacggucaaacgguaucccggugguggacaacacgcccgacguguggcugauuuuaaaucugcggucuggguugaggaugcgguaaaacaaaggcucauugaguggguucccuaucgcagugaugacagcuaacguucuggcuuccguggaguucucuuucacaacugcggaguaggcgucuuggguaaacuugaggggacucucucugcucuccuuuacguugauuuucacggaggccaugcuugugaaccugccgucggaggcgcggacggucagcucauagcggcuucguagcugagucguguucuguauugcgauggugccagucuugugguccauugagaacuucuccccaauguugccuucagugauggaguacaugaccugggagaaugccuuggagucagcgucuguggcguucaccgugaugacguucacgccucuguaugucggcaggagaagagacacuucguacagugacuuagagaagacaggggggcagucguugaugucgaucacgugcacagucacauucgcugcguacucggcgaacagacgaggaguccccaugucgugcacuuggacggugaagugaaaagcauguguuucuucauaguccagacucagcacuguacggauggcgccggugguggggucaauagcaaaauaguugugcacggacggcucaacgauuugauagacgagcagagcauuggauucccugucagcauccgucgcucgaaucaccagcggaacguuccugucugucagcaccacacuguugacggaggcugacucgcugaugaauccugaauauucugccugcgugaaaacgggcggguugucguucucaucccgcacgugcaccaccaccguuguguugguggacaaaccggccauguuggucccuugcacugucaaugaauacaugggcaguguuucaaaauccaaggcucucugagugaugaugcuuccggaaugcggguuaauguuaaaugcgucgcccauguuuccgucucuuauuucauacaucacugaugacuggcugugugcagagaccaucccaacaaaacuuccaauccugauggcuucacuaaucuccgcagaguacucuuuggaugugaacuugggagaggcauugucagcaacagugacagcgauacgcacggaggucaucucgcucauagguggaucgccuuugucuguagcuuuuaccauuaaaucauaaucuacuuggugacuucgguccaauucucuggcaguuuuuauagagcccaagauggggucaauuguaaaagaauuuccaauguuuccuggaagggcaagaaaaaaaagagucagagaaagaaaccuauuagaaaagagccaaggacaacagaaauagcagagaaacagauauuuaaaacuuacacccugaauuuaaauagaaacgaaggggauaucaacaguugaaugagacauucaauuuauuucauuuuuuuuuaacccauuuaaaccguucagaauuuuggcugucaaauaugaaaagcaaagaacagaaaaaaauauauuguuuugugacuaacgccaaaauccucucucugcucaagugaaaaauguguuguagagacacauggcucuccucucaaaauagcaauucagugaaggauuuuccaacagaaugcugaaacucucugcuggaugcaucaauuuuaucagcacucaccacuuuacaagggaaaugcuuaauucacuaagaaauuuuacgcugggguuucagagggcuucuucuuguaagaaguuaggggaccgagaaaccguuuucuguagcccaccgcccuucaggaguuuucaagauguccacaaucuucccuucuuaaccuuugccaagcugacuugaucauguaguuggugacucucaaggaggagagauuuugcuuccagggggacaucuggcagagcucggcugucaacagcacuuggaaaggaggaagcguugcuuccacguagaugauagcagccaagagacaaaaacagcguacgccacgcacaacggccucccucggcaacaaggagcuguuuuugcuuccaaacaucaaccgcacugaugcagccgagaagcaaaccgcuacgacagaugggcuuugcuggcaucuccucggaccuucccaggcucgcccacgcagauucaauauuucccccaaugccucaaaaccccacaggguugggaguuccuaagagaccaguacguacucuccauguucuggauggagcaugggcaccguggggggucucuggggucuaccccuucgcugauccucgcuaucccuuuucugucuuauaaacaaacaucuauacaucacucccagaacgggauccguucuucccugaugaacacuugguggcccagcucgggucaccugccacuaaacuuuucucacacuccucuugcuggguuuuacuaccagcaaacuacuuagugucaucugucaagccaaggauuagcaagccccucucucuccccauuaagaguaagcauuuccucuaccaaauucauuuccuucauuaaauacauuuuccaaaaauccaugacauuuuuuuuuccugaggccagacauagucugguuuucauuagguuggccuggcucuguguccaagccccaaggcagugccuggguuugaaacagggaggaggccccgggcuucuccagacccugaaggucugggcugagccuuggcccaggccucugccaggcugcgcagacgcuaauuuccggccugucugcauuugggagaaucucgauucuagguuauccuugugccucaggcaaucaccaaaccucagaugcuucucuuuguccaccugcccauuacucucaccuuccaaacuugacuggcuggguaggaggugacaccugcucaccuuucuggcaagugacucuaucucucccaagcccccuagcuuucugaggccuguuuuggaaagcagcccauuuggcaacauucauauccauucuucuacacguguuuaucuuauuuuuccacagggaaaucuuauuugcucguaaaaguucauacauccuaggccucaaauguagaagugaaucaacauguuuaguguugcaagacaguguucaagagaugcacuaguguucucagccccggucagaucaacauccucucugcucuccucuccucucaugccagggaccccauauuccacccuguucuccccuaacgcagccuucccuggcuauucucagaaucucucuagucacccauuuacucuuucauuuuucguucaccagaaugccccugccugaagacuccuccuuccuucccuauccgguguggcuacguuuauuuuuuauuauacacguguucucuuuccuccuauuuauuuauuuuugcuuucucucuuguuucuguauagcugagacucaacacgaaaacacuauguaucgcaggcgggacuccuacucaccauccuccggccucagccucccaagggcuaugcuuaaaggcguaugccaucauacccagcuccugaauccucucuauaguauggauaacauucuuacuaugcauacacaaugugaaguucaacaauaucaucaucugcgguauccuagcauugaauuaacaggacccugagcccguugcugacauaaaaaugguaaaaacaggagcccagagugauuugguauuuggaccucacacagguacguaucgggcacaaagcuucagccguacagaaggcagcccagacugccgacugcggaaagugagcgacuggcaacagguacguuuuucucagcccugaaauaacagguuugcccccugagaaugggaauaagguagugggcgaacuuuguaccagggugggguugacauuuaugcuugcugaagugguauaacuuuaaauuauagucuugcauuucaacgggggaguuaucuggacuaacaagucaauguugcccuuaagucgugacuauuuacuagauagcacagaaaagagacauguagugggaccccaucucuuccuaugucugacacauggcccgugcguguucaguaaggacuugcugacaguguggaaaccucucccacgugucaguggcaauuauacuguaaaccugagggacaaagccaacucuaauccguagauucaccgaguguuauacaucuccagggcugacaacaguaggaaaguaaugcucuaaucugcuucucugacaagccgacaccacccagaguacagcacuuagucucuugugcguaauucaguuacuacuggaaaaacccuuucauuaaauuacuuucucugaagacuucaaaucagagaaaaacuauugcucaauaaauuucuccuaauuaaacaugcagguaaauuuaauaaccaagucucuugaacuuuauuaaaugcaaucagauacaaauuagaaacagcuaauuaugaauaaauguucaaugaaaggcaauaugaacauuuuacaguucaccauguuccaauggguauauguacacacacacacacacacacacacacacuucugaacucucacaguaguggcuuccuauagaaguuuuuuuuuuuagcacauuacauuaugaaagcugugucuuacagccuuauuccacacgggaacaguccaauggcgcuuacucuauucuuuggggagacacagaguuccauucucagaauaccaaauuacuaaucccaucagucauuacaaacacucaaagaaugcacaugccuucacucagacaccaacaaucauauuuuaaccacccaguuguugaaaauuaugugaaagccaacggaaaguugaacauuuucgccuacauaaacccagucaguuugucuaugacaaagucucuucauugaaaugcucgggcaugcacgaauggaaugcacuguuuuucuaacugcugaauuucucaagcaguggaaaaaauucuuuaucuccuuuauccaaggcacuaaccugguaacagugcauuuuaacgcucucaucccaggugguauagaaaaucuuaucuguaaauaacaaagucaaccugguucuuuuaagggaaacaaacgaguuucccaacacguaaagaaauaaguuuaauuggcacagaaagcaaaugggcaaguauuuuugucaaacuugcucccuauauacucagauuuagagucugagaucuauaaccugcaaucucugcaugcaaugccuagcagagaccacagacaacaaguuaaguagaguucuaggcuuaaagaaaaucaguagauuaggauacgcuaaaaccauuucacaaaaugacgcgugaaacuggcucuaugucuucuacuaccgaugacugugaggacggugggaaacugaagccuucuccagacucuacacuuagagguauuuagcagggccaacucuuuccugauuuuauucuggaacuccuuggcccaggcucagcugaccuuccuggcuugggcuauaacugugcuaccucuagacaaugugacaggccccuucccagaagccaccacucuguggccuguuucaacagcuggauucuaugcaugauacucuacugucaaaaggacuguggggcuaguucacaaggcacaggacacaggguauccccuuuuucucugagaauugacccaacacagggagauaucauacucuccuggcauuucugagccagagaaaauacucucauuaaaauguugaauuacuaagccagaauuugccugacuaguuuaagagccuaaaaugacuccaaaaaaaaaaaaaaaauacugaauuagaaaaauaaaguucccccacucccguaggauuuaucagucuuaauuuauguuaauacugguaaucuccagaauucuugacacucaagcuuauuaggacuuuaucuuuguuccuuggcagagguuuuuuucccccccuaaaucccuuuugccuuauacauuaaacaguaguuaaaaaagauuuaauccauuucugcagcgcuauguggaaguaugcuucagcaccuagaagcaguuuuagaaaaugcgagauacgccguucaagcacagucacgagacugcacggcuuccgaccuaccugacucgaucgaguagagcacuucagcguuccucccuuugucuuuguccagagcugucacuugcagcacaacugagcccacggcugccgauucauaaacccgcccgucguaggacggacuggugaaccacggugcguggucauucuugucacugacauugacaacaauccuggcaaaguuucguuucacagggacauccugaucccggaccugggagagaaaagucaacauguuaucuacugggguucuucuuucuuguggauuaaaaacaaacaaacaaaaacauaaaauaauacacacauacauacauacauaaauacauaaauaaaaucacuaugcuuuuccaucccaggaaaccugccagucagaaagagagacggcaggguaaagggugccuuccguaccaugaccgugagaacgugcuggugaauggcuucauggucaagcuuuucagcaguguaaagagcgccuguugcgggaucgaggcggaauuucuugaggcuggcuggaucgaugcugcucugcagaguguagaucaacuuguuuuucucaucccuaucuacugcacugaucugcagaaucuccacuucuggcucuguguccucaggaacagcaacuucguauuucgauguagaaaacugggggcgguggucauugguaucuauuacuuugaugaggaccuggaacgaguggcaaggacacucacauaaagacacauucacaauuauguuuuaauacuuaaaaauacauacauauugaaaagaugccauugaaccaaacuacauauggacacgagaaaaaaaaaagcaauaaaaaucuagauucaaagagaguaucuauagcuugucuuugguaugcuauucacuuaauauuuaacaauaacuauagagacagaauucagauuguaguugaaaauugcuugagaaauacaggcgaauuucucauaggucuauaugagaccuuuggaaaugacucauggaaagguauuggacuugacucugccgggauuacaguguacccauuuucuacacuagauuuacaccagugagaggguuaguaacacuaucuaauuccucauucuaaacucugagacuccaaguuccuaauaaguuauuaauacaaaggaacaacuagaaauggcuaaagaugcaauucagcaacugggcacuuucuaagaagcaugcaugagcuugucuuagaaaucccacggcuguuaagguaaggcccugugguuuuaaguuauauuucugugacuucaaacacuauauaaguagugaauguuuuuuuccuaacaguaauuaagaagguugaaaaggaaaaacuccuguaaauauggugacauauaacgacagcuuuagagcaaagagacagaugucaaaaaacuuagucauauuuggaaauaaaacauauuuaccuugacagaugauuaauuuuuggaaugaagugacauagguggauaaggcauagugaaagucagcaccaaucauaaaauaugguuuauaguuuaugaacaagaaagcugagcucgauuggcuucuacagaacacgaggauuugcuaguuuaagaggaacaaggggccaaaguuuuagcagugccagguaacuauagaccucaccacuccacacacacaaagacaguauuuucaugagccuguaccaggguccccaaagaacaccacagcaucaaaggaugcauucucacacccauucuaugugaauacuaaguucgcucaccaaaccacacacacacaaaaagaucauaugugaacaguauguuuccauuugaaacuaccgcugagucacucuuuaagauuaaagaggacccaggaggcacugcuguaaaaagaaguucuuuuauaaaucugaucaaggucuguuuacaaauuuaaagcuuaaguugaccauagugcaggaacugggcaggaguuugacgcugcuccagcagauacgguuaaccauuacucaacaaaggcugaaaagaacuagcgauccauugugacaagguaagguaacccgugagccgcaugcuggcugagcauugguucagggcucucccgcaaggccugaggguaaaaagcaaguguaacagaaacuguccccaguacucuuucaaucucccugggcaaucuccuauuucuacagagccgaaaaccugcuagcacaccauaagaugaguccuuuucaaguccagaggcuggcugggaccuuccaacgcaaggaguccugggaagaggauggucagccaggaaagucaaaguugaggaugcggaccuaucuuuuagagacuggaaagacuuggacucgaaagaacaaagaauggggauggaugugggacugaauacgugcagccucaagucccgagagaaggauggagaauuagcuauccuguccacuucaucagaggaaacacauuccaccgccucgucuccgucaaguggaccaggaggguuucagggaaguacgugcaauugcggagguguggggucaggagccugcacggugaugcuguaagaugucugugucgugugagcguguccuagggacagacagugcagcaugaagaacaagcccccugagccaccccccuugacccuucuaagaacugggaagacaaacagcagcaccccuacuuuccccgauguggcaacggaagcagagggagccugauccuugccccugcacaggaggaagagguggagacaaaccucaaacaagcucagaaaguagagaucaggauguuccggagaaaggggaagagaaugugagaagagccaagcugccccaacaccaccuucacccugucuuacaaaauaaauuaaaaaggaaaaaaagcagcuggauuuguagguuaucuggagaggcaaaggagagaaaguagaaagauccaaccuccacuucaggcugggaagcguccugagcugaaggaugaagcugugugcccagaacucagacggaugaagcccugugcccaaaacaguggcauccgccaugccccccaugccccccuccugcucuccugggucugacaggaaaucugccgaacccucuuacgcccagcaccugugcuaccaaccugauuagcacagagccgcucugcgaguucuugauuuucacccacacaccugcaacugccagugcugcaagccuuaucagcacaggucagguagccgagagucuccucacaggauacacccuacuccgcuccagaucucuaucucccuguugugcacagucccagacagaaaccuaaaccuaauuacugccuguucccuuuguccccaccaccccaggucagccugggcucugucacaguucuguuauguucccacaaccucuucaugccagugaucccuugggauacugucaggacugucugagcaugcuccagaguaagucacaggacuauacacaccacccuggaauuuaaaagacggaacacuaaugaaucuccugcauuucaggggaguuuuaguaauguagaucaaaaauucauauuaggagcuaacuaaaggcgcgguuuucggaaaaggaaggguuacauuacuaauuaugucuuaaugagauaaugucaccauauggagacaugguuguggcaaugaggaaggcuggauggccaucuccacacucccccaagucccgccaaccaccuuccagucaguccugugaaguagacugugcucugugcacagggaccguguaaaucuaccgaacaauaaccauuaagguuuauuguaauuuuuuuuuuaauucucacuuucauucucuauaguuuaacaucaggggcuuauuucccaaaagaaaaaaucaauuucugcuccuugucacuucaacgagaagagcaaugaccaaaucagaaagggcaaaauggcagagcauccuccacacggcaacucaaaaaugaccccaaagcagacaccaccgcccacaaaaccagucuuacacacaugcaaaucacaagugucuggagaaaggaguaagacauuuuuacagcuccccuuaaguuaccuagucacuuauuaacugaacauacaucccagacuguaauuuuuaaacauuaacgaaauuagcuguuagaggagaugacccgucucauuuaagaucgcagagaacauaaucuaaagauggagaaauagcuuucagaagcaucucgggcucuaagcguuggcuuucuuagggauauuuaagugacacacaagucuuugguaucugucaucucaggaccaagagaaugggacuuggguccguuaccaauuauugcuuccaaggaaacaugugauguaauacaauuauucaacaagcacuugugaaugagcgaaugaauggaugaaugaauggaggcuuccuucuaaaacccacaauuacucgucacccagaaacaucauucuggacagccaguucuaagaaucaaagagaauucauuugaaacagagaaguccauuaacuuacaagguuuuaacacugaagcuugaaaaccagaaaccuagccagcuauugauucucagauagcaacaaauaaacacggauggggauuguugcugcagcuuccacgagcuugaguuuauaugauaaaguaggagggagaagggggggggugugauggcagcaacuugggauguuagagcuucaagagaaccaucuacacaacgcauaccgugguaaaacucugugcacacagcuuaaaugugaauguaaagcuaagaagacuucgacaggaaaaugguaaggguguagucuggcuuuaaguuuccuaucgaaguuuuuaugagacugcuaagcaaaaggcaagacucuaucaggauuugcauuaauaaauuuucugccccuaaauaaggacucauggugugcacaucagcacacaacugcccacgcugugcgcacauccugcugugagggcauuuucucggucucucugacagacaugugucacugguguccccuuaccugggugaggaucgugguggucccaucuguugccuccacggugagguuauagcuggauuucuguucugcaucaaggggcuuagcaacgaugauaguuccggugcccuuguccacaucaaaguggcugucauaguugccaccugaaauuaggacaaacagcagugcuagagcaaaucaugcaauaaagauaugccagguguuuuauggcuuucugaaccuuaauggccaggaaaacagacuuuuaauacaauaaucagagugacuccaaggaccugugauuucagaauggccagccagcucuuuagagcguuuuagagaaaaacuggaccuuaaugcgagggagguccagaacuaagaccacgagcaaagagcccugcugacacaaccagucagucacuucugacuuuucggccauuauuaaaguuuguacaucguuaugaaaaccucacugaccauauaguuuucacgacuggaaaacaauuauacuauuuugaguacacuacacuaggaaugacuacuaaaaacacacgcuaauucugaaagaaacacucgugguuaacuugaaucaaaucuauuacgaacuccuuaaaacuauuuucagaaccaaucuccuguccuaccaauacuaucccgauauaccccccaauuacauucuaaacaagacucuuuucaagcuuaugggaauugagacacauuaugaaaagaaguggaauggagauaaggcuuaaugacacacugaaauccuacagcuaaaucaaaacaaaacacacacacacacacacacacacacacacaucaucaucaucaaucaaccaaucaaucaaaccagaaacuacugaugcagggacaaguuaaaauaaaaaugaccauguuugugacugggauggguagccaugcauucacuaugaaaagaaccauggugggaaaaagucucuggaaacaaaaauccaugcuuugauauauauuuuuuuuugaucucauaaucacgugggaaauuaugugaucucagcagauaccuucugcuguacaguucgggucacaagucagcugaaagauguaaaacacuucucuagcaagcgcgucuccuggcacagccaaaggaagcaagcaagcguggaaagcaagcacagaagaagucagucagaccgguucccaacaguggggggaggaggggacaaagucagauacugcaggcacaacguaagaugcuuaauccagaagugugaggagaggaacgauaaacgucgugguuauggucagcuauggcccuagucuuuuccucuucaagaccgacagugagggaggcuucagcgagaaccuuuucacacacugggaggcaacacagcuaagaguagaaggaaguggcugaguucuaacuccagauggugguuacaaacacacuucugauucauuaaguauuccuugugauuaaaauguuguggaggaagagaaaaaaaaaaaaagcuaaggcuagucucuguagcccaugcuuaggaucccagcuaacucaggaggcugaggcagaaauauagcaaguuugaagccacccugagcaacuuaauaugauccugucucaagauuuaaaaaacaaaacaagaaaaauccccaaaguccaguguguggugcagcagccgagagcuugcuugucuaaaguggguggauggcgcaggggacccugugagcuuuuagagcuguguuauagucuuuuaaaaguaagccgaggaugugugaguucauuaaaucacaaaaaugcugacuuaagcauguaaguuuuagaggaggauggagcuuccugaaaaaaugagguaaauaacacuaagaagcuauggucaacaguauaaauuccauauaaucacaaauaauagcacgccucuauguguguuuguguguaugugugugcgugugugugugugagagagagagagagagagagagagagagagagagagagagggaggaggggaaggaggggggggaggaggugaaggaggaaaaacugguccaaaacauuuaaauucuuaaaacuaaaacuaccuguguauguccaaaagcaaauuuuguaaaagugcucacugacuggauggcuauuuuauguuuauucuuuuaaaauuauuauguguauggauguuuuuccauuguguuuaaucugcauaaucaaucccacaggcaugcagugacgauggaggccagaagggggcaucagauucccuggaacuggugcuauagauuguaaacugucacgaggguuuuggaaucuaagcaggguccucuggaagagccccuggcucuccguggauccauuucuccacacccaggaguacuuauuugacuauauguugugagaucuucugcuggucucaaaccacggcagucuaaggaaauucuucaccucuagaccuuuucccaaauucacauucuaacaugagaaaaccacaucagccugucaguagcccagaggaggaugacgagagcuaagagcgcccgccacguaccgaugaugucaaaccacagaggcaugccagggggcucaacugagaucacgccgaucaugugagccaccggaucacuuuccauuacgguaaaugagaaaaccgauuccucaaacgaaaucggcuccgaggacggcuuggguuuggagauccacucgauauggagccuggugguggacgacuucugggggcgcccguugucaacugccuuaaucuauaagauaugaacggggagacgaaaaacagcaaaucacaugugacaucggcaagcuucagagcaacuauaguuugaucaccuacuaagugucagauacuccaaacuugugucugaauacaguguaugcugacugcuggcugaugaggaguuucauggccauauauguuggggugagagccaguaagaaaauaaacccgcgcuccccaaacgccaaguucagguugcgacacugaaacugcuuucucaauggagaagagaggaaucggacucacggaaagaaugucauauucuccggccgcagaaaacuuuuuggacgagaccacucccguuuuggguucgauggagaaccugccgugcucguugccuuccucgaugcuguaggagagcuccgcauugggccccucguccuuauccgcggcuaugacgcgguagaggggcucgcgcuucgaagcgcuccgguccccguccgccuuuucccgcucugggagccugauuuuguaaaacuucugaaggaauugaggccuguugucguucucaucgaggauuuucacgaugacucuggcaaugguggaucuggggggaacaccguugucugucacaguaaccugcguuuuaaagguaagagauaacaacaugucagaguaccaaaaaacgaguguuuucuagguuaauuaaagggauguugaauauuuuuaaguccucuuaaaaaauucccuuugaguauucaaacacaaagucuccacauaccacauuaaaacugucauuuuaguggauuugugugugugaaauaauccuaaaguaucauuuuaaaguguacuuauuacaaauuuaaauaucauagguuugaaugcuaacgaugaguuugagaguuuucuuauaccauuuuaaauacuuaagaagauggacacuuacgcccauuguaucacaggauuuucagaaaaaaagaaaaggcaauguuaaguaauuugcuucuagguuacucaugugcuccaguaucugacacuaagcaaugggcuacaucugagucuauaucacccugaaaguuuacauuuacaucugugugugugaaaaauaauggcccuaaucaggacuccuuucagucaagcucugccuccuucuaaauuaacugaaaauacuaaaaauguugagagaauaaaauuuuucaugaacggacguucuuuuggaaacuugguaguugucaauccuaguaagaaaaguguggauguaucaucacgggccuugucagaggauuuaggaaacuaacaguuguuucuauacauugaagcacaagguuuaucuuccuaagcuuuucaggaugaaacaaaaugauuguuuuaguguuagcuccucugaacacuuccugccugucacaugucaggugggacaaacuggaggggaggggcaaacuggagaagacauguaaccaaacacuguguaucgcagguuucacuaaguucggugucaacaaauaagcuuuuccaaagucugaaguaauauacuccugucuccagggcagguaaacugacaccagcuggucuucaaauacagacaccaaagaaugacagacacauacagcccauacacaaacgccuuccacaucuuuugggucaaugccuuagcacugucugcaaagcccuuuugugccuuauagcugcucccauguggcuuuugacgcuccuugugaaagagauaacacucuacaauaaguagagaacuuuugugaaaccugaaguuacaaccagagggagaggggaugaacccccacaguugccugagguuuuugguacuuccccaugcuuucuuucuccagcauccaucccuucccugagucaauuucuguaguaacugaaugaaaauucaaagcccugcucuguaauaaagaaaaugaauucaagggagccacacaaccuguaaaugaaagcucgacuccaguaagaaucacuguuaggaagacucggaggcucugaaggcagcugguaacccacgcgugcgugcaugcacccacaugcacaugcaggcuuaaaaagaaauauuuuacuaauaacauaggcuauuuugaccaaagaugaaauugaguagacaguaggaauaaguucuuuuuuaaaagaaaucgcaagucaucguuuagaauuuucucuacaaaccacgcuguugagaguuuggacaugucacacagucggcucacaaauaacaaaagcagcugacccuacgccuggcucugauagugaaauuagcaucugaugagaaaaguucacagaggcacggcuugcucugcugugcccugucucugaagguggcugccccuguccaccuccaugguacauguuaccugucaccuucaaaccacucccacacugucauucugcgaacuauugucucccaaccaaaacgggcuaaaacgagucagugcaaaaaacaucugaaauuacccaaauauuuuagaagaggaaauguuccacccccaccuccuuugacguuugauauuuuuagaaaauuucuuuagguuacaaacaaauucuaguguacuacuauaugacuaacacaaugauuuaaguguuaaaaaccaccuggaaaucaacaacacacaguuuaucaacaguuagccuugaucuauagauaugucuuacaggcauaaccgggagaagucuacagaagguacagagaaaaacaucgcuccugcaaauaaaauucaaaugacuuugguuacaaaaguauuuguaaauuuguguaaggggcgcagguaaagaagaacaaaguucaaaaggguacuaagggguacuuggggcugaguuccuuuccucugaggauggacugaggugggggagaggggauauucauaauaagacauuggcagccaugaaugacagacggcaggagugagggugcucucaggguguuuuguuagaaauaaaggggccgggugugguggcgcacaccuuuaaucccagcacucgggaggcugaggcagguggauuucugaguuugaggccagcuuggucuacagagugaguuccaggacagccagggcuacacugagaaacccugucucgaaaaaccaggaaaaaaaaaaaaaaagaaagaaaggaaggcuuacuucuagaaugugcucguccugcuguucucgguccagcuuccucgacgugguugugaugagaccuggaaaaggguggacacuuauugaucagagcgaaauaccauccacccccacaccggacuaguuuacucagaagccgcaggcacacugugcacugucuugcucuaacgauucuugggaacaccgggcaaagggcagaacuuuuauggaaagggaagaacucaaaucuacuacaucuccuggucaucagacauucggucagaauagaauuuuaaagguaaaaugaaguuauccaggacuuauucucuuccuguaucucuaauaccugcuccagaguuaagauaaauaaauggugaauucaguucuagaaccauacugaaaaggaaccauuagaaaccuauaacuuacuaucuucuagucaucuaucuucaaauaaagaauugcuauuaaaaagauaauaaaauauuuuuauuccuuauuauaaauuggcugacuguuguuauuacuucaacaacagucagccaauuuauaauaagagaauaagaaaaugaugcccacccuguauuccccauuucuuugauuauauuaucaaacuagaauaaaaugucaaccugucucuaggacuuuaaucuuaauaucucuugaaucaucaauauaugccaugagcuagaagacugccaaaauuguuaaaauguaucuggaugcuucgcuaaagugaauuccacuagccaugaaagcagcggcucucacccuuccuaaugcugcgacccuuuaauacauuuccucaugcuguggugacccccaucauaaaauuauuuuuguugcuauuucauaacuguaauuuugcugcuguuaaggaccguaauguaaauuucugugcuuucugguggucuuaagagacgugcgacugcccagaggggccccaacccucggauugagaagcacugcacuaaggcauuggugcaauuggcaucagcagcagcgggugcauugacuugauuucaggggaaguucacuuagccagguuggugcuggguugauccugcuucccagcauugccaggaaaauaguucaauaagucaggaguuugcagcuguggcugucugaacacgacagagccaggagaugcucugggcugaaacuccugagguccuaccgcuucccauggagcuacugacuuaacggcuuccaggaggccaaggagcuuucguuaagagugugacccuguaugaguagacagaucuccuccaacggcuggucccauacuccuuaagccuaugggcaguauacaugggacuuggcaggacacucuuuaaaaugaggaugugaaauuggaaggguguuggggagggaaaugaguacgaucaaaacacacuggagauaauucucaaagaacuagugaaaacucccuuuaaaagaaaaccggcuuuccucauaguuaacuuccucccauaucccuaacuaccuuuacaguuaacggcuauuauaaaauguuucucuaaaucugcaaauaccagauguauauguuuauuaacucaaugcuuuguguuuuuaaauaacugcucaaauaacuucuaagcacaaccuuccaacuggccuuucaacaaaccacaagauuguguuacugcuggacacuggaccucuucccaaacucuaccuauagacaacuggagcucaagaagacgcuuccggucuuguaacaacaggacagcacuucaaugguacaggccuuuuaguccucuguuccagaaaagguucauaggccaccgccacccgcucacaaacaacugugguuuuaaagcaauugaaaaacaggaaaucgcuuuuaucuguucuaccugacuguccuaaagcucucauaagauagucacgaccacugguaagauggcacggaaaauagcaugauaugcucacaagaagaacuucugccuggcacucaggcauucaccgagggcacccaggaaaauuugccaugaacacuucacuuacaucaaagugcuaacaaaggauuuaaccaucuguauuaccaauucaacauggaaccuaguuacuugaccagguuucaguuuagacucaccggaacaaaccuccaggcuuccuguuaaacaccuccccggacccccaccaccccauccccuuacccuccaccugccucccuucaccacuguaacacagaggaacugagauucuauuuaaaugcaaugaauugcaaggccuacuucaauuaacugccauccccucacuuuaaaccgagucaacuguaaaguucccuagggcuaauggcccagugagggccaccgcauaugugggucaugggauguucaugccaaagcagugauccaaauguagaauacaaccccaaaauaagguccuguaaggaacuccgcuugcuuuguauuauuuuuauuuuuuuuguagacgaugugcaugguaauuuggaacuuuccuagacucagaacacuccuaccagaagaauccuauccacgguuucuauggcuaucucccagaagccuccgccaggcagcacaggcuaugccugugagucugacgcgcagugugaagagaggugccuuucucaaaggaguacaguauguuugaugcuuacuacagaaacuucgugcaaaaugaacucuaaaguacaaguccuuacugcagcagggaagcuagccacuucucuagggugugccccaccuuccugggguacacuuuaggaggcacacagagagguuaacacccuggggugccagcccaaccugcagcaucccuggccugcugcacggcacuuguucuguguuuauaauucaucauucugcuugcaggucggcuuccugcugaugcccgcccaacccccucccuccccacuggacaaacaccugcuucacaacugaauauucacugggugacuaaccuuguagguguuaauaucugagugaggcauuauguguccuaagaaauauuauacauuccuuuaaaaagauguauaugcaugcaguguuucccccugaaucccaggaagacacacccuuuaucagaaagggcacaaugaccaaggucaggugucugagcuaaaaggaaguuaauuuuucuccgaggucaccaggcacucauuaacaaggucaguuagaauugaguucucuagggacccagaugagaauuuuuuuuuaacuucccaucgcauuaaacacauaacuuaguguguuuaugguauuucaauucuuuguaaagccuugacugugaauucagcaaaucuuaacaggggaaauggccgugauuagucacuauucauucuggugggucaaaaaaguaagucagaaacugaaagagaagauaaaagcagagagcaugcacaccacaggcggccccuuccugcaucuacugucauuuucugcaagcaucgugaaguuaaaaauagaaaggaaaagaggggacaaagacuagaaauguuccuuccuugaucuagaaaaacauuacauucucuauacauggggcaggcugaaagggcugguaaauuucccaccuucacacuaauuaguauccucaaauuuaccucagaagugugaaugagacuaaaggagaacaccaaaccuuaccaaaugagcagaacugacaagugacuuguacucuuuucacaucaaugcccacguuuagaaaguuaaggcagacguuuagauucgcuguaacucucccauguuaaccuaaccuuaaaauucuuuaacucaggaccuccucuaagacaaggucuucgagaggguaggcagcacacacaggcaccuaucaaaggccggcuagguggagauggagcagcuacacgcuuauucaacaacucuguccuguccauucagacccucacaggggaaaaaaagaaaaccagagggaacaagugaggcucuggaagaaacaacagaaaaagggggagggggaggagggagagaaguuaguuuaaacagcaucacaaacacaaggggacagccagccagagggugaaaacccacgauuucugaacaagacugagguccaguuaccaugaagggcggagcacuugagaucuguagcaggugaaauuuacaaacaguaaagcuaucgggcaagguccugagugugugccagccaccggcuuaacccuacauggcaggaaacugacuuucaaccaucuuccuaucauucuccuuuaagacuaaaaccaggaaggggaggcaggcagcagaggguuagggggugggggcagggcagucaccuaauccuacuuuauuuccuuuuccaugucuuuggcuacauuuuuuacuuuuuacaauaauaagaagagccacuguagcuuuugaccuuauaaagcacuauccaaagcaguuucucuuagccugaaauucucucaauucccacugcccaacacaguagcaucuaauugcgcccagccgcugagcagcuggaauguggccaggcuaacugagaaaguggagauuucagaaugaauuuaaauaacuuaaaaaggcacuggucauuuuugcugcuuucaauagccucuuguuccaaauuacaugccaacauguggcucaacaauguucagaauauguuugugguuaaaaagcuaaagauacaauucaaugacgaauacauccguuaucaaaauccaggcuuguaaacauuugcccuacaaaugcaacguuuuccgcuguucuggcgugggggccaccacucucuguccuccaauccucagacuccguccuuagaauucaguucacagaguucagccggagaugaagaacccuugucauugucacuuuauagcuuugccuaauacccccccaaaaucacaucuuuguguucaaccugacuuccgaaaauuaauuuguuuaccagcacacgcuuuuugcauuugauggcuuuucugaugguuuaaaguugaaaauuaaguugcuaggccccggugacgcugccguaauauuuaaccagcucagaguuccccaguuguucugccugcauuauuacucaaugugcuugucaaaauggccuccccaaauguauccucugagagagacacaaagcucuugcccucgacgguaagacagaucagaggugaggggucuaaguuaugugaggggucuagguaaugugacagugcuaacaauguuuauaagucuguucggugcaagcacucuuucauguauacuuuuaaaaaaacaaauaaauaagccaagcuguagaagggccagaagacgugaccucuugguugacagcugucacagguccuuuccuggugcuuguaagcaguuacaccuagggggaccagccagccuguuaucauggcaucccagcugcuucaauacaaagguggccugaggcagcugcacucuggccacuaggcuuucgaaaccgugguuuugguaaaggcacaaacuucuucagcagguuugucccaguuaagacagcuccaggcaacucagaagaccucagaagcaagcaagggaagacuuaguggccuccaggucacuucuacagcugccccaggcccaggcuccgccuuuuaacagcugugcuugauuaggcacaaacccaggaaggcgccucuccuagugacucaacagaaagcuugcaaauucccaaccugagggcucugacuggucccuaacucaaggcauuugacgugcugaacuggaaacugugcagugaccuguggaauuacauaggaacucaagaaaugccacgauccuuuuccaaauguaucaucaggcugugcuuucaugggcucuaguaaaggguugucauaucacaggucaaaaagaaaaagcugagcuggccacagggaaaagcagcaccuuuuguuuuguuuuguuuuguuuuuuggugguagaguuagcggcugcuuucaguuuuguuuggggagacuggauaucccuagcugccccagaucuuggguuccuuuugccuaggccuccagaauccuggcuuuacaggugugacccaccacccccugcuuccuuuuuagcacaauaauugggugcuuccuuuggugccaggcuaagcauucuaggaaucagaaacauuaaggaaaaucaaaauaagauaagcccuaggggcagucaguaaagugguugagcaaccuuuagacaaagagcuaccagaacuaagaggcaaacguuauugugagccuuggguaugaaugcuaacuuccuauacaaaauguauauggaaauauuuacaaagcaauuugucaaaagagaaaggaggaacuggucagggaagagacugagacggggcaaggaagguguuuccuuuccuauacuagaauucucaaggaagggaucuucaguucuuaacaaaucuuuuacuugaaacuuuauagccuuaaaaauacguuaaaacucaaagcaaaagauauaggagaacaauuuacuggguggaaauuuuagauggaaaagaauccaauacaguauuucuuucucuuuccuuccuuccuucuuucuuaagauuuauuuauuuguuauuuauaugaguauacaguagcugucuucagacacaccagaagagagcaucagaucccacuauagaugcuugugagccaucaggugguugcugggaauugaacucagguccucuggagccaucucuccagcccccaauacagauuucuaaagccugaacuaugcagccauugacaaacauaaauaagacuuauagauauauauguguauauauauauauauauauauauuuuauauuuauauuuuauauaaguaugcugucuucaugcacacuaggaaagaugucagaucacauuauacauagauaguugugagucacuacgugguugcugggaauugaauucacaacuucuuaaccucuaagccaucucuccagucccacauuuucguuuucauuuuaaaccaccacaguggcaagugggagacaacuucuucuaauaaguuaaagcaacuggaaauggaaugaauuuuauucuaaauuagagucccacuacacaaaccauauuuccuagaaguggagaguguuuaaaauucccgcccaggcaggggugguacacgccuuuaaucccagggagucccuugacucccucauauaccauguucuacacugugcauuucucauuuaccauguuauacagugugacucccucauauaccauguucuacagugugcauuucugccaccugaguagaaauguaugcccucagggguucaccuaaaaaaaaaaaaaacaaaaacaaaacaaacaaacaaacaaaaacaccgaaacaggcagggcacagugacaucagugagauuaaucaagacaguagcuccaaaacuaacaggacaauguauccucucuagucagaaaacacucacucucccugcauucucaaaccuaucuuuuucaucuuagcuaucucucuguuccucuuacacacugauaccauuuuuuuuaaccucaaaaauaaugucaacuaucagaauaaaauagcaguaguuaaagacaguguucuagcugcuaaacaagucucuucacgucuccauaacauaacaacauuaaaauacacaucgucaguuguacugccucaggaacucagaagcuacagucauaggggaaauaaaucauuauguuuuaagaugacauauuaaaaauacucuaccggcagugguggcgcaugccuuuaaucccagcacuugggaggcagagacaggcagauuucugaguucgaggccagccuggucuacagaguuaguuccaggacagccaaggcuacacagagaaacccugucucgaaaaaccaaaaaaguacucugaggcaucaauauaggagacaauaagaaauaccauguguaccaugugacugcaugagcaucuucuccaugaacacuuuagccuguauauuugaaacagcucuaaugaaauaaaaaauggccucggaccaaagacaucuguagcagcugggaagaucacagaggagggggguggguguguguggguguggguaagguggagagacaggcaagcaacggaugcuaaagggggccuggggaaagcagaaccauuccaacuggcugaguuuuuaaacccuuuaccagugaacuggaaagcaagcagggagugaguagcauucccacagccagcgcugugcuuggcucugucauggauacaauaacuggguacagaaagguccuggcccuugaggacuggagccaggaagagaaccaagcaacagggcaagaucagaaccaacaaugaaaaagucagagucuugcuuagcucagaccaucagggggcaggacaacacgucucccuuuucccaugcuggagacuuggagggcgucauaggcggaggcaaagguucagcucuccccaucaacucuccuauagcugucauugugcaucuacucuuagagcuucugucggaggcucucagagccuuggcagcgugcgcugucuuccuauagguaguguucugagaccgguucuaacugcaguuggcugggagaucuuuggcagcuguggccaucugagcagcuauuguuugucacugcaguacuggugccggcaggauuaggcuuggagccaaaaauggaauucuauucauagccugucagggcuggaaaggagcucggaauucacuuaacucgaacuuucagagguccgcagaaaacacuaauaaaauuaaucagacggucacucugaagccacacaaggaggggcugaggucaguaucgcccgcuuuucuucugcuuuuacaucuguucugcgagcuguuuccugguggaaauuagugguuucagaacacaagaucagaaggcaaaucaauuuugcugugaauuaauuguuuuuaguauucuauauaaguuauguaggagggaaggaggccuggagggagggaaagcacucaaucaacuguaagguuaauaucuaagguuaacaucggcaaacuucaacgaaagcaucuuaagugcaaaaucuuacauguacuuuagucacugacguucagugaccuagaaucgcagaauucuccuugauccaacugacccuaaggaucccacgaaaacagauuugauggggggaaaaaugcaccagauaaggcaggagauaaaaccugacuuuuaagacuuuagagguaauacauuucaccauaaaauaaaaacuaguaaugagaaauagauuuuaaaaaagucuauagcccuuaaaauacacgaaggugacuuucuguuguuguuguuaaugaaucccugccauuguggcgugaguggccuuucaguuccuuccuuucuagagcuaucaaauguuacaccggaaacccucggaaguuguuugcggcuguaacuacuuccuauugaacuguguuaggucuccuuuccagccacaauaaaaugccauuuucuuauugccucauuacucaguaauacaagacucacuuacuaaaggagcaugcagcuagaaugcgauuaggugcccaguauaucuacuacccacugcaguauucugcagugauuaaagaacgcucgguuugucgauuacuaaauguaaauauucuauuuccacuaaaucuguuuguaaucuucuacugaacagucacaccaucccuuauauacccgacacagauagcucuuuaugaaauacucuauucuacauguaagcaaggaaaucagaggcccuuguauauugguguucuccuaaaagcacaacaaauguauaauguaguccuuuugaguaugaacaacucagucccagacaagguuacgaaaaaaaacaggggagggaggaaccuuccaagaaccaagagccaaccaggggagcuggcacugcagcucuggcuguuuguaauaagauauaccagcaguacaagggcgaaaauaucaaauuuaggcaucuuuuaucuuccagugagaaaugauuuauuucuuaaaggggaaaagaacuaauuaguauugcuacccacuucuaaacaucuaccaggaacuuguuaaaucucaaaaaacaugcuuaauaacgcauauucuaaguguuguaauuuaagcgccuggaaaggcaacacucagucugucuauaugcacucuuguuuacagaaugggaaaaguugggucuuuuauuucagaguuuaauaauuuaaauagcugcugccccauuucaagaaaaaagaaaaaaaaaucaauacgugaaguauuuccauuguuacguauaacacaucagugucagggaacuguugcucaacuuguauggacuuuaaauugugaauggcuagacacauuuuauaauacugaaagcuauacaaacuugaaaguuccuuuuaucauugaacuacaaacacugagcuaaaugacugugacagacacuggacagacugccuaccuaaaaacuucccuggccuuuuauacaaaauggucaguaauuccuccaguacacgguuaaugguagcaagcuuaaggagcuaggaucauuuaagagcauugugguuuuuaaugugaaaagggccacagaaacaguaucagacuaaaagcaacuaugcucugacacagcauucuuucggauacagaauaaccaccgcaaaaccacacucacacauccaagacgcaguacccagaagcagcagggaggaaauccaugccugugguuuggacccugggugguccugaccucucugaagucauguaauuauuuguaaagugaggaaaaugcaagucucccuuuggagacucuguuuggagucucucugcccuuagcacaaggccccucccccaggaagauuuaaaggauuuaaguggaucaaaguugauugcaaaaugcaaagcacaaaucagaggaagaagaguguggccugaacucccaaaaaugggcaaaaaugaggcuaagagacuguagaagggcuaggaagucuaaguucacaacagaaaguuaagagucaagaaagaaaagccagggguugcugcucucucuugacugcccccugaaguucggcucucaaagacaaccaaagugcaucagaaagaacaccagcagcauuggaagagccuaaaguguucuaaaccauugauccagagacgaacagacuggguaggaccucaacccaaccggagcaacuuuggcuggggauauagcucagcgguaagaguguuugccuaguguaugugggucuuuggguucaauccccauuacugucccaaaguggggaggagcaagccacccucaaauuccaaacccauuuuuaaauaucucaaggggacagaaauauaugauucagccaaugaagagacugacuuacagugugccuacugauacaacuaaccccacaaaccaaagccaggaugcccgcuuaugcccauuacccauuccuagucuauuuagcauggcuacaaaauauaauucuucauauauuucuuuccagagaggaagaaggacagcagugaaugaaaauuagucaaacaguaaccuauuuacuagaggagauaagagccgauagaugaaagggccagagguaggcggguggauacacaucuauagucaaagaaucauuugcugagccugucaaucacuacccuaaagggauuuuucuaaaccauuuugccuggcuuaccuaggagagaaaagaaauagaagcaguugccucugugcuuggaaauacaggcugcauuauuaugcaguguggagagcccaaaagaugaaucuuuuacuaugucccacugcuugcucccuaaguacuggaacaaagucaaggggcagaaagcauggccaagauaaggugaaauaaaggagccugggggugggcggcuuagauagcaucuagcagcucagagcaagcacacugggaagauuccagcuaagggacagggcaagggugggucagacuaacaaaagaguuaugagcaucaaucagcucaggguucgcuaguguacuggcuaauuuuaugucaauuucacacaagccacagucauuagaggagagacagccucaaucaagaagauaccucuguaagaucgggcuguaggaaauccuguagggcauuuucuuaauuugugauugauugugggaagagccuagaccaauguggacggagccagcccuguccuggguucuauaagcaaccaggcugagcaagccauagugaguaaacaguuacccuccaugggcucugcaucagcuccugcccucacuguguuugaugaagaacuguuaccuagaacuguugagugaaauaaacccuugccuucccaaguugcuuuucgguccuggugcuucacugcagcaauggaaacccaaacugagagagucaguuugccugugaaaggcaacugcucugccauucuccauccccagcccccagagaggcuccagaggccagagcaccaaugcagaaaaagaaaacacucacuuaagacaccagggacgggaaugaaggacuacauaaaagugaaagcacucacugggaaucuuucugugcccuuugaauccugcauuaugugacucaauuacuuaaugaagucaggaauauaaucgagaagggaugugccugugugcagacaucccaaggcccaguguuguuaggcacagaaugcaaguaauuaauggucauuaugaagagcacagucuaggcagaacuuaaggacagauacucuggguguccucaauguuauaguuuagagagacauaaagugaacucuaaugucuuuuuuuuuuuaacuagcuccagaaacccaugauacuaaauaaguuuauauguaaaauuaaucaggaaauucaauuuuuauuauuuaaacacacacacacacaucuuuguuggaauuaucuaguacuccuuuaaugaagccuuuugggggaggaguauacacagaauuauugcaaagcugaaacugaauaaacauuuuuaggauucaaaaaaaaaaaaaaaaccugagcuucuacaucuacacaaggggccagauuacacuuaacaauaccaaagguaagaaaaauggacaaaguaacaguuugcaggcaaaaauaaaagggguggggaguggggugaggggggagugacucuuaaugagcuaucuugaagguuuucagaauauucaucccuacaugagaaccaggagauacgcacuaaugaccuccugaagacuaaauaguaaaggcagcauuauuuccuacaaccaaacacaguaacaguuacauaacugcccaucaaucacuaaaaggauaaacuguaucuacauaaggaauacaaacaacaacaacagacuuaagggcucauacagagcugcagcgcgcaugacucucaaauaaguggagugcuaaacccuucuccccaaguuuacacaccaugucaucagcccauuugugaaauucuaugggcaaauuuauauauaacuaauauaauggcagggaacaccagagaucaccuagggaugggggcaaagaaccagacgacagaaacccaggaggcaauucuuuagaaauaccuauaugcucacugccugacacagugaugggucccugggucuggacaaagguggauuuaccuccugcuaauuauaccccaagggagcuuuuuaaaaguaaaaagacuuacauuguaucaaaaccuuagaagauagcaaauucacaagacuugggacuuuuccguagcaggcacaagccugaagaguaaccuucaaaauuaucaggcgacugggaacuguguaucucuccucaaagcugcuaacagguggggucaguuuccuaagguuaccagaggauaaugaaauauguaaagcucacacugguggcuuuugucugggccccuccucuguccuuggcauaccacagagcucugaugcuuuggauugcgugagcaggcagauucaaggcuccaaacaauaaaauaucugugucccugccucucucuugccuugagcaaaggcacaauuuuugaaagacgcaaacugacccuaacugauacuggaaauagccaaacaacaaggaaaaguuacuaauguuuacucucuguuaacaaaaguaucuagguuaggaaagugagcuaaaccuuuagccugugcgcccuaaaagagaaaucacaucaaguccuacuuauaauuaguagacuagcaacugccugagaugaagcaagacagccucagcaccauaauuaaacgcuggaagauacuaaaaaaagaaguucauucaagccugaugcuuggagaccaaacuuuagaaaugauugcaguuccagaaagcuucuuugaaaaaacauauucuugucaacaacaacaacaacaaaaaccacauagggaugcucuccucauuuacaaaaugacugugaguaaauggguguuuaagucuauacaaaauguucuaaggacuuuauacagacucuagaaaacaagucccucccuccuucagucauaaaggccacauaaacacuagcuucaguccuuacccggcagucaagucgccuaagccugucucuuggacagacuacucucccugcuucucccagcuucaaaauaagcccaacagcucuuccagggccuucuacuuccugacugccccaugccaccagugugacugcaguuacugcaaacaccuucaucacaggcugcgucaggccccugcucacgaggccuucccuguguuucuucuauaucuacagggcaaaaucugaagaccuuucacguccugacaccuuaaacguuaggcuuccugguauccaauaaucccugggaagcgaacacacauuguuccuuaugcuuguugcgccccccaccccccaccauguagagcuguaugaagccacuaaaaucgugguugucauacauccaucaaacaagcagcugaaacaugcaaggaaacaggcuguggcauauucuccacaaaggaccccgaggaguccaggaggagggccuuaauaagagugucaaucgcuggucgcuaauccuaaagccugccucccgcccuaaugucugcuuccuccgugaucccaaagagaagacuaacuacagccacaucugaguuccugcccggugauuuuccuccuucagacauuaauuacuaaggacccugauuuaaggucuccaagugguguuccgggucaguaaaucacaagagcuuucuucuuucagagagucuuucaccggcucccaccacccagccuccauuuuaacaaaccaccucuuaagacgcagugccugcuguacgguuucagaggaugagacgaccuacugaugucccuugagccuugaagaucaugcugagaccuuccacugagcuggagacacaccucgcuguacuuauuuauacucuauuuuuucuuaaccguauguuugcuaaagcaugauuauuuuuggaccguuaaggacauggcuggggcucugugaaacucucuaaccauaguuuguaacugacacaccucucagcagcuagccccauacacuagagucggccucuacuuccugucugccuucaagcuguaaaaacaaccugcuuggagauggauucucuccagcugucuucucagcauuauacacgcgccucacacccgggggugagagcucaccgugaacuccuagaggcuguguguucgcacagaagagcucaggcaccauuuccuaagcggccuaagggagaaacgcaaagggaaggcaaggcuggaccagggcuauuccugagaccuagccuagaccaucuuuaaacuuucugucuccuauuaauuaugcccagagcugcaguguuugcucggauacuggaaggaaacguauugcuugcuuuccugucucuucacaggggacuuaaucaaaucuaaaagagggacagaaggcauaaaauaagaaacauuuuuaaagucuaauucaguaagcaguuuuaaauggaacuaguuauuuuuauuauauauuguacuauaugucacauaauauauauguguauauauaugcauauauauauauauauaaauaaaaacauaaauacucuuuuuaguuaucaccucggggcuuuuacuucucucuuuccauacuggggccauuccuucuguucaggcaugcuaucuggacucuaaaccuccucugaaauuauuuuaaacugacaccuuucuucuuuuacagcaggugacgugcuuuaaauuuuugacucuuagguuuuggguacuuucauuugaccucgcagcaacagugggaccuaauuaccacccggaccuggaaaacagcacaccucagucugcagcaacagcccuacacuagcccuacccggcauagguaagacaggcugcuaacccacuucuuagcuccaaguucaccaugcugccuucaaugcuccuggaaagagacuacucucagauccuacacauuucucuucuauguaccucaguucaaggcucaaucugucuugauaaauccaaacuauacuagcuuuuugugugugugucccaaaagcugggauacaauuauccccaaacaaacaaaacaauuuauaaagcacucaaaagaacucuugaagucacucaacuacuauagaaaaguauuuauaauggcaggcucaaauaugcugacaagcuuuacaaacuaacaacuuaaccauagcuugcgcacacaaacacacacacacacacacacacacacacacacacacacacacacacacaggggauagaaccuaacacacacacacacauuggggauagaacccagggcuucucuuauguuaggcaaaugcuugguugcuaacuuacaucaccagcucuuagacacauuucauuuccuauaggaacuuagaacuuagguaccucucaagauuugcuugguuuuuuuuuuuguuuguuuguuuuuuguuuuguuuuguuuuguuuuuuuaaguucaaugaaacaaaguaagacauaaugauauggggagaagaaaugguaaggaagacgaagcuuggagccuucugacauucaaaacaggugagacagagguguaagaagagcuaaauaagucuugcucucuagaaugccagguucgucagauucuaccagcaaagauggaagaagacacauacaacguccagucauugacaggcuaagcgauucaguuuccugcaaguaaacuuuucuuucaaagccguacaguagcuguuguuuuaacugauuacuaauaauaaauagaauuguucugcacucaacgugaaaaguuuccauagcagaaacaggagcuaugugcucacuauacaaaugauaacacauggaucaucgauuugugugggguggggguggggguggauuuaaagaagccuaagacucaggaaacaaauaaaacauuauuaaauauggaagagcagagucugggcucacaggaucgagagaccuugaccguggagucaagcuccuaaaaagcagagggccacagagauucauuuuuaaaugaaucucuguguauaucuuugagguuuuaucugugagcacacgggcuauauaagccaaaggcauuagaucccuggggcuaaaguuacaaaagagccacuuaaaguggguucugggagcugaacucaguugaguccucgacaagggagcucaggcucuuaacuacugagcuaucucuucagcccugggugugugagugagugugugugagaguguguaagugugugugugugugugugugucacagucuuugagaagagaacaauguauugucuuccaacccuaaaguggcuuggcccugauccugucacuuacagucagaguucugggaaaaauuuaaaacaguacuuagaaaguaaugaaguauggaauaaaaaaucuaauauuuuucaccaaaaaagaaaauauauaaaaauucagauacuuaguagcaaauuugaucuaggcuuacggcaucaucacugaauuacuuuuaaaaaugacaacugcuuuagacccagggcgcaaaacuugacuaugaaggaaaacucauccaucagcuauaugguaggaagcccaaagaguacgcacugugugugaauuaaauuucacccacaaaucaaaccuuguucugaggaacugaagaggaaaaagagguaccaaaccaaagaaacuuuggcaagagagaaauacgaacuccuagcucucaacugggagaguguacucacacacacacacacacacacacacacaacguaccugucuuaggauguauugagaagaauccuugaggguucccgcuuguaauucuguaugucaguuugucauuggagcuagaauccgggucaaaagccucaaucuggaccacagauacauccuugggugaguuuuccaugauuucuggauaguacacggguucugaugucuguggcgcguugucauugacauccuccaccucuauguagaccucuaugaaggacgacagaggcaccacgcccugaucuguggcauagaccgugagccaguagugggaagucgacucucuauccagucggucugaagucucuauaacaccuagaaauaagaggccaaagaagaaaguuaacaacaagcacaagaugccaccugugucgaagaauaacaacuccgcugguggcuuaugugucacgugccccaguuucccugccuaaaggaggaagauaaaugcauacuccuuaguggcuggauaaaugaguuaauaccuaugaaaugguuagauauguagcauauaauauggacuaaguauuuacaauuacuagugucaaacaaacuacuuuaaaaaucuaugaucuaagcugggauuaaaggaauacguauggaucucugugaguucgaggccagccugguuuacaaggagagccagagaucccuagugagacccugucuugaaaaaaacaaaaaggcaaaaccaaucaaacagaaaaucuacgaucuaagcugaaaguaacccaggagauaggcacuaagagaucaucucauggucuaacacacuguguuccaaagauaaaauuuauggcugguuaauauauguugaguuuuauggagauuaagcaggaaaccaaagauaaaccagagugagggcucagcuccauggucucagucccacucaguaagccacaacucagggaaagagacucggaguaacuuuccucuagacagccagaguaauugggguaaggcuauccaauccuuaaaaacaaaaaaagcuaaggaaaaaaauaggaaagauuugcaagccucgcauaagagauuacucaggucucuuauauguuaaaccucuuaacaucuuuaaccaucuuaagcaaacagacaaccaguauguuauaaaaauauaaauucucccaguugaacuccaaggguguaucuuuccuagcugcuccuggaguuucugguuccucauacgaaacacagcaacuaugcacuucaugaauaaacugcccaagcuggaguuaggauacagagucuuccacugagauccaaaccagggccguuguuacugagagaacugggaagaggggaaucauauacccaccgaaaacagacccaguuacagacaucuauuaaaacuucaauuccagaauccuccaacaaaguaaucagaaguagaaaugugaacucucuuaagcaaaucuggccuuuccccgauuuccugggcugccacuccauuaaaaugcaauuaaacccauuggacaagugaaguguuauuagaaaauuucaaguagacaagacacauggugguucugcccccugccucucacuucuaaccguuagauauuucaugcugcuugcuugcuugcuugcuugcuugcuugcuugcuuucuuuuucuuucuuucuuucuuucuuucuuucuuucuuucuuucuuuccuuccuuccuuccuuccuuccuuccuuccuucuucuuuccuuccuuccuuucuuuuucuuaaucauaauucucuugauguucauaaagcaaugacaauucuauacacaauuuucucuggauucacuccaugccagacaucgugguagccccgugcuguaccgugacaccuuuccugacacgccucgacuagugaugcuauuguuuccacuucaugaugaaaaccucagacgugaggaacauucccaguaaagggcagauccuuggaacccagagccagcacaaagccugguccugucuauucugagcacaaugauuggaggauaaagaucaauacucaggugaagauuauacauucauucaaauacaacagcuuuaaggagaagacaugaaaugcaagcacggugugauggacgaccggugauuggcuuuccuuuacauuuuuuuuccucgucucaucuauguagccuucugcuuagaacugguucuccgguccaaucaaccacgcacagggcaaaagucauguucaucuugaugugaaugccuccuaagaacuccuagcuauggccaggagaauagcugaguauaaggaaagguugggaacaauguuguauuaaauauuaauuaagagaguaagacuagggaccgugaaggccacuucccuauggcaggaagucagguuacagggauggaccgcagggguugauaggaguccagcccauucuuuacagaaagccucagcucuaaaauaauccacaugccagucaucuagaaguaugaccagaaauaauauuuauucuuugagucacucugaguccuuauuccuguaaucaacacagcuaccaccaacaccagggaaagaauggcaaauaaaacugacaccuucgagccaucacggggugugaaugagacaaccauacucauucuuaaaauucuacuccucuucuuaauucucuugccucugagucaacuuucaaaugcugauaaccagugaugacuuuuuuuuuucuuuuuuuucuuuccuuuuuuuuuuuuuuugcauaagaaguuacaaacuuguucuuccugggaaaaauaaaaucuagucuuuaaaugaaucuuaucccgacuucgacaaccuguugcgguuuucccuccagaccugucuguuccuaguuauaauuuucuaucuuucauuucuuugcuuuuuaaacaaaagcagaaugguugcuaugagacagaaucuccugccucuguaucaggugcugggauuauggguccuuaccaaaccaugccuggcucucuuucaccuuuuagauagcagugacaguaugcaauuagaggacagauaaggccagggugucaagaggaagaggcaacccagccuucuaaaauucccucugguuagaugcagaaguaaaaucuaguagaauggggaggaacaggguaaucacaggacgcuuaucuggugaggaaugugggagccacacaggaugaccagggagacuuucaaugacaaccaugcugcgcacagaagacagcccagacaugccuguacuaugagcugccagcagugugcuauaaucaggaauuguucccuuucuuuaaugaaguauuacagaagucugagugcccaacuuucuaaccuugagaauacaaugaagacauuuuuuccaaaaaaggcugcuaauaagcugaacaaccugaaaaagggcuggaaaucugaaaccauuagcuaaaacuauuuaucauuccuaacgugcuucacgggauugcaaagccaccaccagaugucacuauggaaacugacuuuaaauaugcaucgguugaaauugcuacuaugcugaagggagagaucacgugacuucuaaaagagcacucauccauaaaugggauaucuuuuaucaaauaccuagggauuuagggauggaggaggaggaggaagaaagaugcuaagagccagaggugauaggggacucugaggaaacaagagucuuccagauacugauacacagcaagaaacuaagguagcacacacaagaccugugccugguucaaaccaaacaaaaccccugcagugaacacaggaaguagauaaaaagucccgccccuaacaagaaggcuccugcaaguuuugccugcuggcaaagagaaagucaguuuucucgaugggcgugucaccagguaucucaaccagacccgaggcacacccugugcugggagaggaggccaacacaagaaaaggcucccugggucuuuuguauuuuugucauauuguuaagguuuuuugguuggguuuuuguuguuguuguuuuguuuuguuuuguuuuguuuuuugguggguaaggaaguagguaggaucuuggaacuggggguaagaaaaagaauauaaucaggauauacuauaugaaaaaaaauuuaauuaugaaaaagaaaacauagcuguggcagacccucgucccagaaagacucagcagauauuuaaccaagucgguauuggugucauuuuucccuggccugguuuuucuaggcuuguggcacaucauaccaauugcucaagaaaacaguuacagguccaucaagcuuuccagucuugcuaccacuaaggcugguuucacugucacuucaaauccugucugcccucagcaucuaccucacagcugacacuguggccuccauuccaacauagggacuuuuguaaggcaaaaugacguugccacacugccaaaacaaaacaaaacaaaaagugagugauucaacuuuccaugcccacagaacaccucuccuauugaaguuugccaauuuuaguuaacggaccaugguugcuagugggaccuagugccagagauucugauaaaacuguuauuucugaaucuuuggauacuccuacucaaaaauaaaguucagaacacaacugcacaguagccuccuuuaaaacugggaggggcuggggaugcaacuucacgagacggcacuugcuagggagcaagccucggauuugggugccagcauuaagucacccaacccuuaucuccaaauguugcaguuuagugucuuucuauuauagauaccuaacaccugggacaaguaaccuaacuugauagaagcguuauucugucucacaccaucagaauaccaugaucaacagucauacugauaaaugucauagccuuugaggcuuuuaaaggagugaaaauuuuaaaucugacucaucuuuaaaauaaccaccaauuuuacaugcaacauuaucuaauaagaaacccuugaauucuuuuagaacugugugaucgaucacauauauacacauauauauaaaacauaguauauuauauauaauauaugaucacauagaugucuguauggacauuauauaauauauacauauauauauaacuuaauauauauuauauacaauauauaauauauagagaugauuaauauauaagaugggaaaauguaaagacugaaauguaaugguuuuacuuuguacagaaacaaugaaaaacuaaauucuaguacuuuugaaaaccagaaugcuccaugaauauuuacauguacauauaaguaccuaaaauuguaauuuucugaagucagaugacuacagaaaauaccaaacacuuuauaaguacugacagucagcuggaagcgcugccuccugcuuguaaucucaaggcucugaggcuuaaguaagaaacugccucggacggaguucagugccagccucggcuccagugugaccacaugucaaauaacagaagaaaugcaagugaacacauaaucgaaaaccaugucuuaggggccacgcacaguccuacagagaaaccacuuuguauuuaagaacauaaucagccacagauaaaaucccagcagagccgaggacagcuacugaccaacauggcucaauccuucacagccaguaacuugucacggcugucauuuauauccgggaacacaggaaauccacggcaauaaugguagcagcagcacucgggagcaccacugacuucugaauagauauguccucgcuggaagcccugagaugaaucacugggagggggcuuggaggauucaaagacccaagccagacccagugagugagugaguguguguguguguguguguguguguguguaugugugucugccuuugugugucuauguuuguaugugugugucuguguguguaugccugugucugacucucugaacaugcacacacauuucuucagagcaauagaacacuaagacagguacauuggcugcaggaagaaaugccaaugguguacaaacugaguaaaaacuaaaaaucugccuuauacacauuaaaagauaugcagaaaaacaacagccagaauaaacaagcugaaaggacgcagaaaccuagugggcuaaaauauuuucauaaaucuguaaauuucaguaacaguucaaaaauccauacugaaaaugcauacaauaaguuaaauuaaaaaaaaaaacaaaaccaaaaugcccucucuguaguaggauauucuuaauucuuucucuagaucacagauauguaucuuuaaauagauuuuucuguacauauuuaagguauguaaaugguauucaggcaugcauacaauuaaaaagaauauucauggcuaaguaaauuuauauauauauaguuucucaaaacuacuuuucuuccuccauugcucguaagaagagcagccaagaucuauauacucauuaggcuagaacccaaaaccaacacaauuuaacucugucuuuccuugugccuuagagacgcaugcuuguccauucugugugucugccucucugcaggaaauaaaacaaauauucauuuucaaggaguuaucuccauuucauguacaguaaguagauguuuaacaaugcauacuguaacaccuucaacaauuaacauuucaaaguacacuuccaagaaugcacaagguuuuaguucuaagaugucuguauuuuguugucuagcacuaagcagaaauuaaugauucaagggagaggcuuuuuuuuuuaauguggcaauggucauauuugcuuauuaucuugucuuauaucuccuuaauuaaaagaauguguaucucuaaacuuccauuugaaacuguugagguagcuuuaaagggagcuaagcaagauuuuaagauuugaagcuuacuggucuuacauuaauuaaguacauaaucugauuuggggcaucacguuucaagccuggagauuucuucagcucagcaacgagucacugccagggcugccuugcagaggacccacuccacauucagauguccauguccgaaucguugauacuucuuaucagggcucaaauggauaaacucucuuuguaaaagaggggcuccuccucggguauuaaaaauuauccaaauaccaauacauaugaagucugccuuuggagaaacuuucccccuuuuuaggcuaguggaugcacuucacaaguaccuuacacgcaccaaauuguguguguguguguguguguaugugugugugugugugugugugugagagagagagagagagagagagagagagagagagagacugacucacuuuauaguucuggcuguccuagaccuuaccauggagcccugauuggccuuagauccaacagccugugccuucugugugcuaggauuaaagguguuuguuugacacuguucaugcaccauaaauuuaaucucaucuccaugguccuguaagcucaacgaguauuuucccauuuuaaguauuuaagaauggagaccugaggcugaagucacaggucuaaaauaacacaccagucauccuagcagcaucuccacaaacuaaguccccagcuacucgucugcauguucugcaucccagagguugauaagcuucaaaagcuaagagagacuucuucguacauugcucgaccugggaagaaaagaaccagaaccuaagacuugacuaaaugaauaucucuggaggccacaccagggugcugcggucuucugcaagggaagguagucgcuauccaucuguuaaggggaaguuacacacugucugaaguuggucaacccuugacuaugacagagaagcaacaugguugaccugaagaacccaacuaaaggcugaggagccgauuaaggaggcucaggggauacaggugagugaaucccacgaagacaaagaaggaaaagccugcaacggaagagaacucugcagcgcuccaccacaaacaccacaaaguuacuauacgucguaccacagcaucucccuacguugcgcagacuauacucacacuaaaaugauauccuguauuaauaguaggacagauaucaugagauaacugggaauacaauacuaauguuaaaauauuaagcgggaaguaucggauccugaguucugaaucauaagccaguuuuaaguuuauacaaauuuccgggugugguggggcacgccuuuaaucccagcacuugggaggcagaggcagguggauuucugaguucgagcccagccuggucuacagagugaauuccaggacagccagggcuacacagagaaacccugucucgaaaaaccaaaaauaaaaaaaacaaaaaacaaaagugacaaauuaagaaaaaaacgcuuugggaaagaaauagauucccugucaguccgaauucaguccucagcggugaccuaucagagauuugaaaacuaccgcaugcuuuaucuuccucgucaacagcagcaccucaugcuguuuauugaaucuugaguuuggcuggaaauaauguagagcucacaagaaugccacuuggccuaaugcaugugaccaacaugaaguuccuaccaugugccaggcggccaaggaacucagaagagaaagacggggucucggggaggaaauaauuaagugaaaauucauucgccagaccagcagggucaagaaguguuuaagaaggagaacgcugaauuuuaccaucuuaguagaucacagcucucucccaugaucuuacacaauaaucacggccuagcuccaucuugaggcacugggggguuagaacugugggcagacauuaauuaguuccuccacuugacauuuucuaacuugugccaaagaaguaucucuacugauaugaauuaaagcacuguuucacuaaggguuaacugaaggccuuaucaacacacugaagaaaucucaagaauguaaaaggugagggcaacguacagguuucccuaagccgacuaacgaccgcuuagagcguguguaugaaaaaguuauguuucaguaugaagacaaagccccauucagggagugaaaugucaguugaaacaggcgggccugugccagccucccaggcuccuugcuaaagaaggaauggaaugagcucgggccugccccucuccagaccgcccagcucacugcacacacagagcuccugccaagacggccaguugucucccaguccuagagugcacaagcuggaagagagcagaagggagcaggccuccccuucccugagcccgcucgggcuccuacaaaacagaauuuaaaugcagaaaaggaccggcaacugauucucuaaaaauaaaaucuaagauccauacgcaauucagcugugcaaaaaaguaaggcguguuccacgagaacggagugccaaccgaacaaauaaaaauuccacuugcuuuggacacuugugcuaauggggcugggucagcucccaccgccuucuuucuuuuauggcuagaacuuuugaccagauguguggcagggauuuuuucuuuuaacuuuaauaaagcaauuucucaauuuaaaaaaacucaaaguuacuuacauauugaaaagaaagaauguacaggaacuauccaaaauacucauuuuugcuguuaaaucccaaaauuuaucagaauucaaacacuucugggugaaucuaagcaagucauggacugcuucagaaacacugcuugguuacuuaguagauagaaacccugaccaccacguuuuaugcuagcaaacaucucagauuacuucagcuaucuccaaugaucucaauucacugcaagguuugauuacacagacccgggagccuuuguucaaacagaggucaccgguagggguccugcauagguuuucugaucucccaguuuucuuagguaaaugaaauuauuuacauaacugaggaguucuaauuugauauuuuaaugacaaaagauagcgugcaaaugggugcuaagagaaguaaucaagguuagggaaucuaggcaggcagcauacaaacaaaccacccuaccaagauuucccaaccuuggugguggcggguuaucuggaggacgcuauuuuaagcagauaggaaacaaucaaggcucuugaaaacagugagcucaguucgaagacuaagaaaagcuguugcugauucaucaguucagagaccaaaaaacuacaacucuuaagacauggaaagacgaaguuaagaacagacugguagggccgggaagguagcucaauugauaaggcgcuugguaggugaguaugaggaccuggguucagaucaacaauaacuacauuaaaaaccaugcagaagucuaugccuauaaaucccagggcuggggaggcagagacagaagggucuuggggcuugcugaccagguagugcuacccauucugugaguuccaggcucagugagaggcccugacuuaaucacaaauccucaaaccauuacucgggagauuacuauaugacuauuucaaaaaugaagaauaaaauaauuccagcacuacccagaccggccucaagcucaagcacgccuggaaucaaccuugcgagugagucauggacuacagacauauuacaggcauuugcucccacacugagccguaaugaccaaccucugcacuuacgaagaagcauuaacuccguagagagaaagcuggcuaacagaaggacguuauuaugaaaacggcuccaagacagagagcuacuggaaucacuggcaacuuuuuggcauggugacauggucuacaaaugacccugggacuaagacacaugcggccuguggaccucaggcuggauaugccuaaaaggucuggugauccaucauacuagcaguuacuuaaacaagcaacaucaaggaaaaaaaaaaaagaguacguguguguguguguguguguguguguguacugcauguguggaugucaaaaaaguccauacugaugccuuccuccacugcccuccaccccaucuuuaaagauuuaucuucacuugucuguaugaguguguguaugcguggauacuauuuuauagaggccuccagagacaagaagaggacaugagaucagccagaacuaaagguacaaagguugugugcugcccaaugugggaccuggaaaccaaacacaggacuccuugcagggagagcaaguguucuuaagucccaagucaucccuucagcuccuccaccauauauuaagacuagacuggcuagucggugacuccccaggguccuccuguccccaccucccagcaggaggacuucaagcacugccacuacaucccauguuuuacgugggugcugguccuuacgccuguguaacaagcucugugcccgcaaggcguguccccugcccugacuaaagacaggcagccacugcacuccuccacaaagacaggagcggagccagaggacuucaggaugauguuaguucuaaugggcauguaaaugugacaugagcacuguguacaucacuguuggcaaaacaaaggcuccauguuuccccaacuccaauaaaauacagaacugguuuuuauaaaguuucacuucagauaugaagugaaauccaaacugggggaaauggcgugacaaacgccuagagcacaaacggaauggcgggccagaagcaguguugccuccugcucucguugcuauguauuuucauuaaauuuagucacugcugauucucaaacuagccgaguccgugaaacucauccugaaggugaauguuucaucccuauggaauacugacuccuuaguugccaaaugaauuuaucagcaccauauuaaggagacaagagacauugcaggaacccuuccaggagagcugaaagcaagcccagguuguugugaaugcaggacucugaaucacacaccuccuugagaguucccucuacauacugccuuaccuucugcuacaaaaagcugcccuugcuucuaacauggcuuuuaugaaugcuaugcauaaagacaacuuuucagaaaguaaaaaagcacguuucugaaaugaaaaaaaaauugcuuuuaaugauuuuuuuuaaguaguuaaaacagcaaucuggcuuauaauguuuauauccaaaauaaaaucuacugccagacagguaaaucgguuuggguaggccauccaaacugagaggagccaugaggcacacagaagagcauuuuucguguaucuugcuaucagugaauacagauuaucucagaggcucugcgggaagccagagguaaagcucagacuaggacaaaaacugucagugggcuuccaggacaauaggucggccagcagcaagaagggggugcacugacccccaagcccagagagcacaaacuccuggcucugagaaggccuggcuguaguguaggauguggaucuucaggagagacaaacgaccaguggccucuggaacugacugggguauccuggcucaccuagcccaagcucaaggcaaacuuagaguacaacauacaaacaggacuguaugugaagacucacugccguuuccguucagaagguaucuucagacaccugucuuuccacucaggucaccggaccuagcuuuuaacuccucccuggccggcuuucccggccacucacucuacaggggcacugaccaccacgugccaccaaggugcugcugugccauuuauuucccuacacugcugagcuccaucaagguggggcucgaaggcauggaguucauuugguucaccuuguuucaucuguagaaagcaagcuucauaaagaacauagcacugucuaccuugugucuaccuuguacauggaagaccuccgccgcacucugaacacguucuggcaggaggagcuguccauaggugcuaaauacucggaauggaaagcaugcagaacucuuccgcuaagucagcgguucucaacccuccuaaugccgccacccuuuaacacaguuucuccuauggugacucucaaccauuaaaucaucuuugaugcuacuugauaaguccaauguugcuacugucaugaacuguaaugcaaauguuugcuaagggggggggggguuugcgacccacagguugagaaccaguccuaugccuuccuucgucugcaaugaaggguguaagggugauggacuguacacacucacugcuaaugagcaguccuuggggcacagguggcauccuaucccacccccaccccacgcugggcucccacacucugggcuaauucaauaaacaaguuaucgucuuccgaguacaggaucagcuguucuuauacuuuguucuucacucugcaaguuacccauuugggggaggaaugggagaaauuucucaaaaugguuaaauucucucaguggcaccucuaaaaucuucauagacccccucccaaaauuaaaccacaaaauauugcauaaaaauauaagaaaacagaauuuuccaguuuuuacuacuaauagcucaacaggauagcuacuguaucaguuccacggagguaacacagacaugacucacuuaugcaaauaagugaacaagacaauuaaaugcccagcuagaacuauacauacgcgcuaccuccuuaaggaaguaaggcagaacucgugugcuuuauuagagaaugaacugucuguaagaagccuucuucacagaggaaucucaccugcucacucaauuaaaugauuauggacugcauauuugacaagaauaagguacacucugucuuaagcuauauaaucuagaucccucccccaacuauaaauauauccaaggacagccuaaggcuugcaggucugaaaccuugguucaggagggcaaggccagcugugugagagaacaugcuuuuauaauuuuauucuauaaaauuucauaaauuccgcguuggcucccauccaagacucacuacuguugggugcuucaucccuagaaaaaugugccuuccacaccucaguauuccgaagccggaguggcgcugacacuuggccagcaaucagcugacaaaaacacccuccccacuuccucuuuaggaaacuugaaacaaucgccaugccuuuuccaaggcagucaauauauccuugcacaagugaacagccagguguuaaucguuaacucugggauagcaggggcgagacaagagcauuaaugguagcacucagacacuuucaggcaaacaacgcagacccgguagcaauucagcaacaauggaacaacuauaaacaacauggugaccucucauuaaacacagacguggcuuggauuuaauacuuggcuuuuaguuuugacuagcuggaaaggucacucuccucccacuuugccaauuccuuuuauaauccaaaagccgugaauuugggaauuaagcagccaaccccacuuaugccugaaacacuguaucuucgagggaaaauuaaaagcuaaccagugcccucuauaaucccuugggcaaaaaaggugaaguacacagggcccagccucaaagccgagaugccagcugcaaccuggaagcacauuccuccccuaucugccauccucggaugaagcucgccuuucuuucacuagggaaggguacuccaagggcauugaauccccaucaaacaaaccagcucagaaaggcaaggaaagggagaacaaacccuacauuucaggaaguaauacgcugaacccaggcguugccugcauccuucaguacugucuaccauagcagagccguucagaacugcaauuggagagugugcaauuggugugcucucucacaccagagcggccacuggugugagagagcaauuaauuuaaucuauacacugauauuuguuagagcauaaugugccuggccuagagacuccuaguucaacagagagaucuucauauacuuacauucagauuuuacaauuagagcaggagaaagaacagaaacuaaaagcccaugguagcuuuagacauccuaauaacagaucgagucauccuuuguccucagauacggauggauuauacaaucaacacauuuaguucuggcuaucuuuuccuuuggguauauuuuagagguuccuuucuagaacuuuugggagaauuucccaaguaaacugccuucaaaaauguauuuaguccugcuuaagacuucccaaauauggaauucugugacugcuauaacucauuuuuauaaagccaacauacauucuauggcuucucuaacaggcaaggcuuucucuuaauuucuacucagaaucuuucccuacaggugaaguaagaagcauuggguuuugaacucuuguuuaguuugguagguugcaccaugaagccccgaagauuuauuccugcaucuguagguaauggacaauuuccaagcacccaagcaguggaacccacuguaaagaaaucuguucccuuuagcuucuauaacauaacaaucaaacaaaaccuaccugaaaacacgcacaggccccugaguccugugcugcccggcucucugagccaccuaagacaagccccaaagugagaccacaaauggccgaggaggcaagcauuuggaaauacagcccugaaagagcuauaaucaagagccccacugaagcaggcaagcacugucucauuuacaagcaauggauuccuucccuccagaugacuaaagacacauccguucagcaucucagccucuuagaugagcaguaccccuacuccccaaaggcaggaaccuuagguaguagcuaccuuaaccaugugugcccuugguccuccacccaaauucguuagggcucuccugacacauacuuccaucuuuaccgaguaguuggugagcuacauccuacagugcaguuuuugugaauuaccguaauuauaaggagaauacauuucugagcuucugacugugcggcucgcuccuccuuuucccaagggcucacucuuaccuccgcucauguaaaucuguacauuaaccuauuacaucucucccagugcagcacucugccuggagaacaaguaucauguguauacuuaauuccuaaacccacagucuaaaugagcaacucugaaauagcugucaucugcuggccccugugcucagaacagaacccuuggcgucuauggacuucucacaggcuuugcugaaucguggggaggcaggaacagauauugacucaugagcacacaagugucuguaauacccacucaccagcacagggaccagaggucaguccugggugugguuccucaucccucucagaguuuuguuugucgaucuuugguuuugguuuuugggacaaggucucucaauggcugucagcucccuaaguagccuaggcuggggauccagaagcccugaugacccuccucucaaaucucucacuuaggguuacgagccucacccagccauuuuacgugguuucuaggagggcaauucagauccaagcacuuuugugagcggagcuaccaacacaagcuuuccuaacuuuucagccugaauuaagagcuagaaauggcuuguugcuuaaaugcaaauuuguucgucucauagcauccuguagugaagacuuuugucauugaaucacuacugcuuguuauauauguguggacacagaaagggggguuauuuuagaaaauaggaaucacuuagagaaggaaggaagaauguauaguuugggaguuuuaaagguaaagucacuuuucaaauuuaaaaagucccauggcaacuaaaaccauacauucuucuuaaauaugauguugcagagcaagcagcauccagccaaggaaaauaaaaguacaacuugacagguuucuccuacacaaccuucaccaggcacaugggagacauugacuuuauaauaaugaaaaaaaauuuaaaaaaaaaaccugaaacuuaauauauaaaaaugagucacaggauguuacugggacaagaauccaaaaaaaaaaaaauccaaguuaaaccagaguacugucccaaaguuuggcuuauuaaaaacacacuagauuuccaaacaaagccagaaccugagccccgcgaucaacaucggcuguuuccacgcuaaacggugccucuggccaacugguaccgguuugauuucaugaagucuaaaugacucaaaggcagcagcaagacagccaagacccaguaagcugcagguguguuacuguuuccauccagaaauguggcaaucuguuuuaccccacccccaccccccaccuuaaccuacugaccuaggaacuccauuuccuagaaugcauacaugccagguaaccgaagacacacggacaagggagccagguaccuauacaaaagucacacucugcacgcuguuaggcucuggggagccgcagcuuacugccccagauccuacucuugaaggguguuuacagaccagaaaaggcuuugcccagacuaaagggcagaaagccgguaugucugcugugggggaaucuaccucauagugcucacaguaagaugcagaugcacaucagaaaaaguuuccacacggcguugucccgcagggucuucuccuaagcuucauguagcccuacauuuucccagauuucuacaauacucuccuuuuucuuuuauggaaaauaaagauuguuuuuuuaaaaaaauaaauaaauaaagguaguucuuuccuaauuuugucccagugcuauggggaauccacucuucaagaaaagaaucaacauuaugcaaucauucuuuaaauccccccuuucaagaccuuuaauggggacuucagaagccgggcagaagccccagcaggaaacaaauuugcaauucaacagacgcacccacugagagacugcaagaugcacccucgguaguuuuggcaauaauuuccuuuuaucauuccuuugcucccaagagcuuuucaacuccaagcaagcccugcagaaguuaauaggcucuuaauauguucuccccggccugaaccgauuccuguucauaagguaauagugggaccccaggggccccuuucacaggggcuuuagcaaaucuccugcagggggauggccccuaggcagcuccgcuucucuacagcacaggcaguaaccuagucaauagguuccuagcaagacaauuccuacauucaccagccccaagaaaugaagugggagggaguugaagcuuuauugaggaaagagauuuaccugucaccaugaugguuagcccugcgggaguuuaaaaaaaaaaaaagcaguuuucagcugcuguggauuuccuggucaacagccagcacuaaauaaacauauuuacuuaaagcuucauucacaacuuuugaugugaaaccugcccaagccuaacuggaaacagguagauuuucuuucuuucuuuuuuugagauacaaggggcagcggggacaagaugacauagaucuaaaucgcccguguucauuuacaagcaaugacaggagaaguacugagcauguaagaauaaacagaaaagucagcaggugugccuguccccaaguuuacacagaaagaucccacaagcccugaaaauauggccucguuaacagaacggagcaaacaacacugaaaccacacagacaaaagguuuauggaggcacaacuacuuuucauuaacgccucucguuucccgagaaggggaggugagguuuaaugauuacaaguuaauaauuuuggaaacccaugggaccuucccaguuaacagcuuaugauuuucaaguucacuucaaaauggugggcucagacuaaauaaaucauuuggaagauugcucaguaaggagcuguuuuaagccaucauauguaggugugugagaagucaggucucacaggugaagucaaguuagauuuacccacccccaccccacccccaaaacccguuugagcggagcaguuucaauacaauggacauuuauucacucagaauuuuccaaaagcuacccacuggacaguuuuuauauaggaacaaaguuuaggugugaaacugaucggugaguuucuuccccucucccauacacacacccauuaagaagacagcgccaaagucaaauaauuacaaaagucaccuuuaagaacugcgucacuguuaagguuuuaaagccaagucagaggccaguguuucgccaucagcaccucugacaaaggcauuucugccacagcagcacaacaacacuuuuaacgucuuuguugagacggcaucaggccaggcggcagcagcacuggacugucucugccaacacuucucucacaagcgugcaccaacccaucacugggaauuccaccacggccuugcucagaugacaaggcuuuggugguguccccugcaaaauacccacggcaaaauggaaagaaaagagguacccacuaacguaaugacccacccgacgcccccacaccccacaccuccagcaacgggaggaaaaacuguaauuuuuuuucucacuacuaguuuuuuuuuucuucagauuucaguagccauauccucgguuuguaauuaucauguuccccuuccucuaugaagcccuccaugaauaccuaauggcauuaguuauuacaaugcacuacuuaaagggcaugggaaaccagcggcuggcugaaucauaagcagguagcccccauaccagcuagcugcaggaguuaagccagggccacacagcuagacucggggugagggaauaaacacgguagugcucgcugcaauuuuuuuuuaaagggauugcagaugauugagaaauaaacuugguuucccagaaccagcucugcucccguccuucccaaugcucauaacuaagacagaaaaagaccgaaaggcaaaucauccgacacccuggaagcauccagagaaugaguuccagauucuaacuaaucuaagagugugaugcuuuguauauacuuggcccagggaguggcacuauuaggagguguggccuuguuggaguaggugugucacugugagugugggcauuaaaacccucuagcgcugcccugaacucagucuuccacuagcagccuucagaugaagaagauguagaacucucagcucuuccuguaccaugccugccuggaugcugcaauauucccaccuugaugacaauggacugaaccucugaaccuguaagccagccccaauuaaguguuguccuuuauaagaguugccuuggucauggugucuguucacagcaguaaaacucuaagacagggaguggcuuggucagaccuaccuguagugcuauccacauuagacuccaaugaccagcuacccaaugcuaacugacaaauucauccuguacuuaaacccucugucuuaacauguguuguggcccaauggaaccccaagcaggacuagucaauuugagacaggcuguauuauuuuaaacaaagcacugcaacuuaaaacuauccuaugaaaagaagaaugugcggcacuuuccaacaaccggacuuccauccccgggacccacaggguggaaugagagaaccaacuuccacaagcugcccucugaccacauaacaacuagaauccgucacucgaacacuacucuguucaaaauggcuacaugucuauuuccccaggucagaguagccaaagaccccaauccuaaccucaaauucuccagacagaaaugcuaucuggaugcguggggagcuaguccaaucaaucacuugagagaaacagacucacuucagcugaucucagaacacucucauauucuguugcauuuauaucuagucuaaucuaaguuauacuuuugccuaacacuaagcagaauuaaaauguaucaaauguaucuuuaacacauuucuuucuuuuuuuuuuuuuguuuuuuuuuuuuguuuuuuuuuguuuuuuuuugagacaggguuucucuguguagcccuggcuguccuggaacucacucuguagaccaagcuggccucgaacucagaaauccgccugccucugccucccgagugcugggauuaaaggcgugcgccaccacgcccggccauuucuuucuuaauacauuauuuuuauuacauuucuuuuuuguuuuguuuugcuuuuccagacaggguuucucuguguagcccuggcuguccuggagcucacuuuguagaccagucuggccucgaacucagaaaucugccugccucugcaucccaagugcugggauuaaaggugugcgccaccacacccggcaauacauuucuauuuaugcugaaauguaaacagaaauaccaaaaguguggauuaguuuaaauagaaauauauuuaaaauagccugaagauguauuuuaauaugguacuaugcuuugguauuaucuuuuuuaaaaagugagcuauguaagguagaaguuuaagacaccaguuauuuucagaaaccauuuucaaaagccuguaauuucuucaguauacuuaacuuguucucucccaaccaucuuccucuccccacccccacacacauaaaagagagggugggggggaggagacacauuggauaaaaguaccuaugcagauugaaacaugaacacaaaaccuggaacaccuuaaaacccacuaacagguagguagucugguuugaauccgccuacuaacaagccaaccgaaugugggagaggcaacaauguagcauuccugacgucagccuuaagagaagccugggcaccuuugaguuccuggggccaccacgugaacaugacagcccgcgcugagaacacacuauaucaagccaacaccagaagccuagcuacaagcuguacugcagcuaagcccagaagaaccuagcaaagaaaacacccacagaugcugcacaaauugugacagauagcuccgcccaggcucuggguuucccuuccccuacuccaugugggucuuccacauaaucuagacucugcuuccuacgcugcucaaccuuucuaacacucugaugcaucugucucuucugaaaaggauuccacacagaugaugaggaagaaagggcuccuguccuucaaucuucccaaggauacuucuaauuuuaugcucguacagguuaaaaguuuagaaguggaggcccaaauagcaagaaggcagacaaaagauuaaaaguuugugccgggugugguggcacacgccuuuaaucccagcacucgggaggcagaggcagguggauuucugaguucgaggccagccuagucuacaaagugaguuccaggacagccagggcuacacagagaaacccugucucaaaaaaacaaaaaaacaaaaaaaaaaaccaacaacaacaaaaaaguuuguucagauacagucacuaaaauaggguguuuuaauguauuuccuggaaccguuuuuaguuucguacauauuaugguccuuaaaacaguuuggcaaccaggaaugggguauggguuuauaaccccagcuacacaggagaauguggagagagguuugcagacucuaggcugccugaacuacugaaugaguccaaggccagacugagaaaacuggugagaucugucucaaaacacaaaauguaaaaagaaggcuagggauacagcucaucgggagaacacuugccaagcacacaggcaaggcucuguucucaguccccaguacuccaaagaaauggggggcggggggggggggcucuggucacuuaauuaccucccauuauucaaccgggcuuuuaaggaguuugcuucuaaguuaauggcccccaccaacagaaccauucagauuauuaugguguaucuguguccaccaugugggucagagggcgcuuguguggaagccagaggagaauucugcacaggagucagucaguccucuccugcaacacugaaauggcuuccaggacugaacaaguagcuuuaccuggucacccaucuugccagcccuggcuuaucaaaaauuauaucucugcaugugcucagcucaaugcagacagcuuuaaaggugcucugugaacuuuagaagccguuauuaaaacugcagcuuuaagaaacucauuuaacaaugccaaccaaauauagcucccacuccuaaagagagucggacgagaacucaaggcuuggccaaaugaauggcaugaaaagggauggguauucgaacauuuuucaggaggacuauaaagcacacuaucaccauucugcaacugcagggaaauaguucacaccccaggaacacgcagagaccgggagaggagccucagaaucggagacucuucauucuaggcuuuagaaugcaguaugacaaaugaagccguuucuacagagggggaaauagaaacccaaagaggccagcaucguggcuggacucacuucuuguucuaauucuuaccuuggcacguugacaaaagaaugcuuuucaagugaagaaaauagccacuaccuaaaaagagcgugccaagccacagaacaaauguauaaggucuuuccagcagcguuuauuuaggugcuugccuuuaccauuuuaugauaaucauuuugaugucaauuuuugacacauccaaggaaggcuugaugcaugcucuugggccaggcagugcucuaaggcaugagacacagagcagccucugccuccacagacccugccuucuaggcggacaaggcagauuuuaaaaaugcauccacauaauuauuaaaauguaccauaaguagaacaaauuuuaaaaaccuuuggcccagaggggaagagaacgggcuaagccaaggaugugugaaaaucccucacagagacccacuauuuuauaagcuaacuuuaaaaaagugauuugaacagaggugcucugcauggcuugacauggguuauuaaaugaaacucccaggggcugggugugggauagcuucccacuaguuacugcuuggagaggaccccagaggucuccaaaacaacauaagcuauugcucuugguugcccaccagaacuaaaugcuaagacccuauugcuggagacaaaacacacuuugguuacaggacccagaaaaaaaaaaaaaucagguugcgacugaccugaaaagucccucccugcugguuuguucucucgcucuggcaggugauacgcagggcagaagauaaacccagagagaagacaucaaugguccuaaucagugcuggacccugagugccacaaaacugaccugccaggcaagacacgccuacgggggccauaguggcgugaagguucugguggggcgaucaaucacuuuccgauuagaucugaggcccgcuccauaggagggaauucaugacgggugcuguaaaucuggucaaaagucaaaggcuugggcgaucguagaguccaggaggggagccuacuauugcuguuuuguugucaaaaucaccuucucagcacuuauauucauaauaacgcuacuccuauaggaacucccucagccagggcucaggaacauuuuggaugagaggcagaaagagcgugagagucaagggacgagagggugcugagaaaucauguccucugccuaccgcagggccacuguacucaagcuugcuacagguagcaauggcuggccucaguuuagggagggaagaagggagggaaggugggccauaaaggaagaggaagcugagauuagguaagauaaaaaaaaauuucaaagcucuucaaucauaguguuauacucuaugcugugaugcuuauuaauuaggucuuucugguagcaauaacacagacaauuaaaacccaauacaaauuaucuguguucacacuucucuaaucaacacccgacagcuguauaauguuaucccaguauuauaaagaaacacuuucugggggaauacuucuaccaugugcaucccuccugccuuguguccguccccucaaaccccggcagaaaacaccacaccuuugaagauccuuccaaggcauuuccaucugaaauaauggcuuccauucuguugccuauaauaaccaaaugaccucagcaucaacagggccagcucacccgccuuuaaacagcuuaaccaucuucuucggcugagcaacaaaucccaagaugaaaaacaccaaacaacacugguuugguuuauccaaagauggccaucaagaaauaucaacugugugccauguugucuuuuuauaaaagauaagaagagaaggaauauguuugcuggguguguagucagguguggggggaagagguaccucugcgggcccaugcugagguauccucucccccugagggaccagcuucaugaugguauaauauagaauagcguuuauucagggcauggggaaaggaguuaagaggguaguagagacgagagagaaacgcagagagaguagaggccggccaugagcacauggagaggcggaaagggaguugggggaggggaaggagcaagaggacagagcaagaguaagaagagagagaagagggaucgagcagccccuuuuauagugagucaggcacaccuggcuguugccagguaacugugggguggagccuagacuaagugcuaucaugucagguacuaggauaaaccggaaguguccuaauguuaagaggacuccagacucaaguuacaugagugucacugccuuuaagccacagaucagaugucugccacugguacccugacuucaucuucccccaaagguguuugaaccucuuucauaaugaacaauaaccucucagaagaaucacuuucgugguuuguuuuuguuuuguuuuugucuuaaaugagaggccuacucauaaaucuaaccuaguuuauuaaauccuacauaccuugauuuauaaguccguguggacaggaaacuugagucuuugagaaaacugacuuugcuacugaaaugugaguuuucugacagcuuacccaaauaaagaaagacaugcuaguaguggaacaagaguggucagcuggcucgccuaaggacucaaugggcgcccagagagcugcuuaccuuaaauaaaaauagccuguaauguuuacuuuuguggccguguaccucacacaacucaauggggaggcagcacgagcuuaccaaaaaaaaaaaaaaaaaaaaagcuuagcuacauuggguuaagugcccugucauguauauaagaagcucauucaaaugagcauuauuaucaucagguacccuuccucucuuggucagucuccauggcaaccugugaagacuggcaacuuugggacacuggaacagagggauuuaaagcuggggccucuaaggacauggcagguccaucaauagagccucagcccaggauugagcacaggcugcgcuccucaaccugcucagccucugaaggcagaucaaacaucuuuuaucagagcugcaaagcuucuguggcaaccaaacacgcagagcaaugcugucucccgagguuuagaucuagguaucggggacguaggacauuugcacaaucuucauaacuaugauuauuaugucagucgguugcuuguugacccaccagaaauuaugugcugcaguguuggccaaugugcuuagcagagagaugauuacggcuggacucuguccuuggguccaaggagacagaaacggaagagccagauaccaguucagugagaacaccauccccuugagcccagaggagcagcaagaccuggugcuaaggaaaaucugcuccagggaaguaagaaagcaccaaugacuuaucagaccaaccuaacagauuaucuacuauugacugccaauucuaagaauccaaggggaaaggacuuagaauuucccacaauggagcaaucuacaagacaagaacggcuuuuuuuaagcgcauaaaaagaacaaucagauccauaugaagaaagaggcucgugaagaaagcaucugaauggagaauuacgugggaugggaagaagcggaucaggugguggaaguagacccagaaacagggggauggaaaaccaggaaagccagggcaagccucccccagggcaaggggauugggggagggggggggcaagggugcggggacagggcuggcuccacagaucaaucaaaggggaugcagggaaccagugaggggggcacacagacucuuaucagggaaucagggagcgagcuuacaugcauuacccgcugaccacagaacugggaacuugaggccacacgggccucagaagggugaaggggaaggccaugacugauggaggaggugcacaggaaaggcaguagagaaagcuguaacuguaucacaguugaaaucauacugacuucuggcacacuccuguuuuaucaagaaggaauauuucaaggugcaaagccagaaaucaaugcgcuuaaucuugguucggggucacgucuuguauccuugagugaaaaaauaaaaaagauacaguaacagaaggaguagcaucuaaguaaauauacgcacagaucaccaugacacaauugaggccacagccuagguaaaggcucguuauaacaggugggaugcaaugcaagcauccaguaaccagccacuaaacuauccagugaccuauccagaugaggaggaugaaggguguggggugggagaagcucgccaguggcaaggccaugagauaagugaucaccaacuaaaaggguaucaaaauagccagguaacgccuaguuugaaaugugugugugugugugugugugugugugugugugugugugugugcacauauauauguauguauauacacacacacacacauuuuuuuuuccacagaauuccauuccauagguuaguucaucagccaugaaacagguucagugcaaauaaggaauagcuuaaccggcaaggcaagcuaagcuaaaugaugaggucgcccucaauguucauacauguuucuugcuuugcaucauugcugcgaagcuggagagcugccaacucacaagcagaggcauguguccuugaauggcaaucuucucaaguccauuuauuccugguaacaaagucaugaaagacucguggcacuaggucuuauauggcgaacacacaauauuuacagccagcaagguauuaagaauaaaucaauagaugcgggacaauaaccacaaaaauaacacaauaaacaaaacauaaagcugaaauauuaaaaacauggccaauccugcaugccaagcuaaaaaaaaaaaaaaaaaaauccgugaucaaaacaaaagcaacuuaaugguugugggguugaaaauucaacaugggcagauaucuaagguguuaaaaucuauuuucauaaucauagaaggugguuagaugagaaaagaccaaagauucacugagcauuacaucuuuauacacacaggccacgcaucaaauuauaaacaucuaaaccuuccacccucuuagaacacaagaacagcuccuugacagcacaguguuagacuggcuuucuuacuaagcaccagauggugguggggacagcugcagaagccagagcacuaguaagaacaaugucugagcaccaugaccacaaggaacucagggcaaaggggaagcacaaaugagauuagcuucaacuaccccgcaggguacaguggguuugaaggaaccuaguaacuaccuaaagcauugguccucacccucccuaaugcugcggccuuuaacucaguuccucguguugugaggacccucaaccauaaaacuaugcucguugcuacuucauaacuaauuuugcuacccuucuaggccauaauguaaauagcugugcucugucauuuucguaggugacccugugaaagggucauuugaccuuuccaauggucuuagguagccccccugugaaagggucauuugacccccccaaaugggucacaacgcacaggcugagaagcgcugaccuaaagcaccauuuccacuaggcuggggagucugcaugcucaacauuccagaaggcaggcuuuucagggaugcugccgcacgugcuucugguuacaagcauggcugaggcgcaugucagucuuggugcugaaauacaguacaaggcucugaggaaaucgggccccuagauugaacccuaccccacccccaccccguucauguccacgccuaaaaaguaggguucaagcuuccaagacagccagaagucaggcaagggcuuugacguggguuuccucugagcauuccucuggguaccacaacgagcaagugagaagcaauaggaagcucuccuguacccaagcggccuugggcaaaucccuuacucuccuuccccauaaauguuagcuuccgugaaacgcaggccaagugucugguaguuuguaaaaauuaagaagugaauucacauaaagugcuuacaacacuuccuguugguaggauucagaaaguggcugcugcuuacuuuucuguguuguuugguuuuguuuuguuuuguuuucuauuuugucuggggggacaggauguuacuacauacacggcccaggcugguuugcggaugcucacuguguuaucccuaacauggauaacggcuaucuuauacccucuagcucccaugccccacgccgcuucauuugaaccugaaggaauggcaguaagagaagguagcagaguucugaaaaccuuguaaggacuacucuccuccuaucuagaucuucaccaagcacuuaaagcaucgacuugguaaggaccacaacaaauaaccaaagaaaagcgacuacuguuuccuuucaaaacacaagggaguugccuggguugcuaauuagauuucacuuacaccuuuaaaaaauccuccugccucaggagccuuugcagcagcaggcaaggcagccugaccugccucaaccaaacccagcaaccacauaccuucaaagaugauuccugccacagccugacuuucugucucacuggggcugggaaguaaauuucuuucuccucaacucugcuagaagaacaaaggggggggggggggcagacagcagcugcugccacuuaagggaggagacagaaacacaaaaggccuuucaccagcacauuucuuaccucccgaacaggccucccacccuugucucuuuuuaaguuccuguuccuuucgagauguuuuagacccaguuccagugaggggaaacuguucccaccacagcagucaccacaccaccacgggccacccagcuccccagcagucauggccagggaagaccugccagucaggaacaagacaaaaugaccacaagaucuauacguacacacacgcacauacgcacaauauccuucauaaaguuagaauacaacauuuuucagacugggacaaguaacuacauaacauuaauauauucagacuuccagaacauucuccuucucgaugaggugagcagucauguuggcuugaacaagaauucuuucugcuuccgccacagaaacaguauccaccucacagaggaaggccaggggccaaccuccagaggaacaaugccagaaucagugacuaggaugugcccaucaggagaacaccaugaccuguauguacccuuaagagaaaggcagucuguccugggccaggccuagugauggaagccaguagucccagcuacuccagaagagcuggggcaggagucaccacagauggcaaauccaaggcguaccugggccacuuagcaagacccuauaccaaaacuugaaacaaaaggucugagaauacaguguuugccaagcaucagauggauagauggauggauggauggauggauggacggacaaauggaggaagauagguagguacauacagccuucacuuucucuucuauaucucaaauaaggugauucucuuguuaaaacagcuagauuuccauauuaauucauuccaacuuucccauggaaacaaacauaaauuucaguucugaaaacacaaugacagccuaccaguaacacggcgcuaauuagcuuacaauuugcucuuaucuuagugaaagacauggauuccccgcaacagagcaguuagaaccaggaacacucugagacgcguuccuguaccaacccaacacugagccacacuccuccagaaugaagagaaauugugcccccuggcaugggauuaccccacccacuguggggaagagacucaaccagcgugucgacaccauuaacagcuaacaagcacugcuaagcauuccugcagacucacuuaagucucggaaaauggcguaguaccgugguccucaagcaaggacagacaugggggacaagugaccuaagcaauuuguucaguauggaagggaagcucuuucucuuuucugcuacaggucgaagcucacaacaacgcaaccaagagccacggcaaaggagcggaaagcugaguguaauguggaugagcccaaaucuaaaugccagcccagacaugcauuaaagacaccacaaaguguuucuauuaauuccuuuuuagaauucccagcaaggauauuuuuaagugugugugugugugugugugugugugugugcgugcguggugugucugggaacacaggugugugcugguggauaagcacaugaucguacacuagggagcuacggcccagcuuuuccucgauccucaucaugauuuccugaaacggucucucagggaacuuggugguuaguugauucggccagacugucugggcagccggcgagcuugaaggaucugcagcucuacccccauccuugcacuaccuaggggccagcaccacucugacuggauuuacuugccuggguaccggggaugcaaacucaagucuacuuggcacacacucucccuauugaaccacuugcuuggccccuucggagacuucaagagccguaauuagagcucaggaaauugguacucagagaagacaagcuuucccacaccaugcucgacccuugcaaacccucaaguggcagggugaucacauagguccagaucugugagagucgcugggacccaaaagcugcccagaaaaacauaccgagagaugucagaugggcaggcgacugccacccccaccuugaaacgacacagcaguuauagcaaaacauacgaaacucacaacugguaaggcuguguauuuuaaucacguauuuuagggagucuguagaauuuccuuaauuacuacuuuuguagguguuugaaauugacauggauaaagagaagacucccaaacagagcaagaauuagaugucgguugcuggaguguucucugaccuguaagaagcacguaaaaagggacgcacaucugacgguguugaaauaguuaaagccaccacaaaaaccugcucacauuacucaaucuucacgagcagcugaaagccaaaggcgagaggcagaaggcggcgguuucugggucuccggagccaaaacaguugucccaguuuccuucgcuggugcgcucauuuuuuuuuuuuuuaagaagcaacuugggagaaaggagucuguugcauccacuuccagguugcacuuggaucacugcaggaaguugggacgcuggcuuaucucccguggcuuacgcaacccaaccgccacccaagaccaucugcccagugauggaacagccacagugggcggggcuugcccauaucuaucagcauuccaaaaaaaaaaaaaaaaaaaaaaaaaaaacuaaaccccacagguaugaccucaggccaaucagguggaagcauuuaucaacugagggucccucuucgcaguugacuccaguuugugucaaauugacaaagcaccuggcacagcagcucugcccaggcccugaucacugggcacaguaucaagcacacccauggcacaggaaguaggugcaguggcaaugggcagagagcaaagugcucaccugacgucagacauucccaccuccagcuuccuugcauuuuagggcugucuucugugaggucccccacucuucccaaacugucccuacuuuucuucauuagacagguaccuuucuauacuucuauacuugucaaaugaaauaauuagcuugcuaacuuuagcucuguguguauuuauguuaauaucuaugugguuccacuugaaucacauguauaugcagauguguagaggccacugaguguguuccucaaucuaucuaucucucucucucucucucucccucccucccucuaccucccccacccccacaucuuccuuguagggagacgaggaacccugaguuucagggacugaacucugguugucaaggccuugugcagagagcccuuacuuccaagccaucuugcaggcccuucaucuuauauucuuaaacaaggucucuuccugaacccaacguggcuggcuaggcugcccagggacagagcuccaaccgugucugucuccugaggacaggauucaacuccucaugcuuguacagccaacgcuuuuccuuuaccacuaaccccuuaaucuuagcauuucuacuccauuagacaugguuuuccugaagaaauuuaacacuuaauacccaaucuccuggcuagaaaucuacaaaauaacuaggucagacagauuuaccgcccaacauacauuguuucaauacaacaguucaaagucuagcuaguacaucauuuaaaggaucucagaaaccauauacacauaccaccgcccagggagacuaucccucuguaaaacaagaaccccagaauaaugacuuagaaacauucuagcuccacucucaccuuuaacuauaauuauagacguguguaagagucuuucauaugguaaccaaucucagucccuagaaucccggugccucccucaccuccccucccacuaaauuaccacuggaaaaaguccguggccacugcacacugcucuggaccuauuucaggaugcuauccauccugucuccuucuccccauuuggcagcgggaacaaccccaucccuuacauuuauaggugaaaaauaccaguuucuaugugauccuuuuuaaaaagcaaacuauuuucacaaaaaaaaaaaaaaaaaaagacagagccaaaaggcagugcucauaauuuaagucacgaagagaaugcaaauuaaggcucaaauuauauuuugugacucaacuuuaacuucuaacagcuccuuauaggcuuggaaauuuacguugagaggggguaaaaaaacgguuaagaauaacuucccagaaaaucuacaggaaaaguaucaauuucaaccuuaacuccugaguauucuucaauauugauacuggaccaccaauucugauuucuauuggacagaagggcaccccuccaaaaagugucugcuccagaagacuaauuaccaaacacuauugauuacgccauuuuccucugccuuaaacuaauucugagaaguccauuugagugacgcuagugaaauauaaucaaugaggggaaagccccuugacuuaauagaaagcaaaauuuuagugagccuggagccuucgaaucauguucucaggcaaagguuuuauuuuccagaugcugggcacccuaagauagggugacuuacggcuaaaauacugcaggcuuuuguucuugucuuauguguccgguauuaccaaacauaucaaauuuuaacauaauaaaaagaucuucuuagaauacacagaucugugaaagaacaucaaggagaccuguaaacuaagucccacccagaccuuacugguguugagacauuacauuucccuguauuuaccacacucagagggcagggcagucaaagccaaaaccuucaucaauucaccuauuacguuacuguuuauuaagcaguuucugugcacugggcacucuaaagaacuagaugucagagguaaauagccugccccagaaagcccacauccauugcaacacugacuuguaagggcagaucuguguccucaaaggaaaacaguacccacucaagaacuggacacuggagagggguggagguugggggaguaggggcuuaucuaggggguggcaagccuuuaaucccagcacuugggaggcaggcauacaucugaguuugaggccagccuggucuacacagugaguuccaggaugggcagagacacccugucuggaaaaaaaacaaaaaacaaaaaacaaaaaacaaaaacaaaaaaccuggcuacuacagagauuccaggaauugaacuguauucuggagaaaaacuguauguuauagcaaaacaccaacaccauuuccaaaaccuauuaauaaacccaacacguuauuacuuaaugacuuccucacauaaaccuugaugcagccaauccguguauagagugccugccuagcaugcagaagguuaucgguucaaucccccauaccacaaagcauaacaaaacaaauuaaaagaaaauggaaugucuccaucuuauagauuaaauaauucauuuugggaagauccugacugaaagaggcagccugugaugguuugucuaugcugagcccaggaaauggcacuauuagaaggugugguccaguuggaguaggugugguacugugagugugggcuauaagacccucauucuagcugccuggaagucaguauucugcuagcagccuucagaugaagauguagaacucucagcuucuucuguaccaugcuuccugccuugaugauaauggacugaaccucugaaccuguaagccagccccaauuaaaugugguccuuuauaagaguugccuuggucauggugucuguucauagcaguaagacccuaauacacagccaccagccagguauucucaguucaaccuuccacuacccuaccacggccucucaaagccugaaggacauagagcagaugauaaaguaguuuuagugcauaaaagucucuggguauguuguauaacuuugcacguaugcacuacccuccagauggcacuccaacuggugucgauguuaccguaccaccacggaaacaucacaccacgaaacagccuaaucagaaugcuuuucaagguuacuauaaaaccacagugaugaucuugauaauagaguacaaacuucaaagauugguaucccuucuacucaucuuauguacacuugauccuucaguguguagcuucauagcgcaaaaaguguaaacguacuucaaugccaagcccuaacagaaaccaacugggaauucugaugcaaagaagaggagagaggggaggaagugcagccagcagaagagauuaacagcacuugccuguuucuucaucuauccugaagacaccaauuccagagccaucucuaauggaauaccggaucucuccgucucugccugugucuucgucgugagcugacacggucaugacugaugagccaguagggacgucuucuuucacuacacccuucuccacaaagcuggagaacaccggaguguguagguucucauucacgucaacgaccuccacuuccacauagcaaguggaagacagggacacgggcuucccuuugucuuuggcccucacggugagauuauacaguugcuucuucucaaaguccagcugcuggacaauucuaacugcgccgcugaguuuauccacaucaaaguggccuucuccgugauccaggaggcuguaucucaccugacuugacugacccacaucgggaucauaggcuucuaaccacaugaugaugguuccuucugguagaucuucucgaacuuucacugaguaauugggugggaugaaccuagguggguugucauuaacgucaucuagugacaccuucaggagcacgguggagaacaaccgggguuccucuguggcuuggucccuggccucgaucuuuagguaaugcacagguugcacuucacgauccaaaggcuggauaauuuucaccacaccggucaugcugucgauggaaaacuucuccguaucugugagaauagcguaggucacaugcccgcuggggcccagaucuuuaucaguggcuucgaccuggaugauuucacuguucaccuccuugucuucacucacuuccacaaaauagcucuccuguaaaaacucgggcgcauugucauuggcauccagaaccgugacguccagaaggcgccaggcagcccucugggguauaccgaggucguacacgguaauauucaggguguauuuguccauuacuucacggucaaguggagacaggacuuucagcacucccguuuccaugucgaugguaaagcaacuaucaucauucccuccagaaauagcauagacgagcuuuccauugaagccagagucaaggucaguagcauucaugaagaguauauuggcacccaccgggagguucuccuuuaccucaauuccaguuggaagaguaaccccgaacuguggaguauggguauugacggaguaagaaucaaagaaaauauccuccacgucccccugacuguguaacuuauucgccugcaggaguuucucugccaacauuuuggcaacaccggucuccucgcacugcaaguugaccggcuugcgacuggcagccaccguuagguugauguauaacggcguggcaaaauuuucuccgucugucgcugugauucucaaacugugaaaggaaaccuuugcgcccaagccauccgugagggagugcuuuaaggacagcacaccggagcugggguuuaagccaaacaaauccaacucauuuccggcuucaaucugguaccggaccagcugcagcucgucggcgucaauggcagacacggugguuaucugcucccccacaccuaggucucggggaaugguccccucacaguuuauccucucaaacagggguguguugucauucagguuauugagaguaaucguggcgaggacuucgacuucccggcgguauggcaagccccagucagacgcacggauccucagcguguacacgcgaggcaucaguucauaguccagauucucagagguacucacgguucccgugaaguggucaaugacaaacggcacgugauuuaaguuugcaauacuguaagucacguagccauucucccccucgucgggguccaucgcacucacccucgugacugcggcaccgauaggcgcguucucaucgauggaugcuuuguacgaggucuguguaaacucagggggguugcuguuuguaccuaaaacuuugaccaccacucgggcggaggcucuuuugucacuuguugucaccucgaguucaaaaugggaugugugcugccuucuaauggguucuaaaauggaaaugagacccguguugugauucaaaccgaauuuagguuuuccaggagcgcuuuuaaaaacauaccucaaaugggaauaacuaggaauggcuuugaccaggaccacggguguauguggaggggcaaacucacugaucucggcucuguaaacauccauuucaaacuugacagggccagcucugaacuguggagaaaugaugugaacaacuuucacgggggaaaacuggggaggagucccuuugucuuuagccugcaaugucagguuguagccguaaggauggcugucccagucgacggccccgacggcuuucacuuugaaugcuuuacucccugggaaagaccucacuguuuuaaacugcugaaggaggucgccagccacgaugcucaaagacgcuaucuccccguuggcacccugaucacaguccuccacggugaugauggcguagguuggguccuuguccagcucagagggcgacaacgucaccgcgguuaugaugggcgcgcacucguuggccugcuccacgugaacugucagcuuggccaggcugcugaccccacugcuaccguacagcuucaucccccgguccgcagccagaaucuccagcucauagagcugggucucuaggaaaucaagccugccagucaaaacaacgacgccgcuggucggguggauagcaaacacgucaguucugucuuuaaaacuguaguaaaauucgccauuggucccaauguccgcauccguggcacugacucuugcgaugcugguccuuauggcuguguuuuccggcaaagagacgcuguaggaggugggggagaauaagggccuuaagucguuuguauccagcacuuguacccgaaccuucgcucgggccucagcaucgguggcuuucuccacugccuugacgaucagcguguaauggucucucacuucucuguucaggauggcgguauucccuccuuugguucuuauccuuagaaagcagaagucuccgagaacauacucuuccgcuuugaacagguuuucgcugucuccugagacgauuuuguaccuuaucucccacgaggggucuaagauguagaugcccaucuuucugggguggccaacauaggucuucgcugccgaguucucgugcacagugacauuguacuggaaguguguaaacuggauaggagggguggguucaagucuuuggcugccaucacugucuccaaacugcuggaggaagaggagcagaagcagaagcaaggucaagugucuccccauuuuuuaa

SEQ ID NO: 12421 - RNA, 4453 nt, Mus musculus
uguuugggguuugggcuccuggaggggcguucucgggagggccgccggugcaggccgcgcugacacagggccgcuucgcccccggggcuccgugcgcuugcgcucuccccgucccgcaggguccccaacauggcgcaggagguguccgaguaccugagccaaaacccgcggguagccgccuggguggagacgcugcgcugcgagggcgagacggacaaacacuggcgccaccgccgggaguuucugcuucgcaaugccggggaccugguccccgccaccgacgagacugcggacgcggagagcggagcccgcacucggcagcuccagcagcuggucuccuucuccauggccugggcgaaccaugucuuccuagggugccggugaguggagggagcgucgcucuccagccagccuuccgggcuuugcuccacgcccccugccgcuggccggggagcgcuuucgcggggaccggcgacgcuggggagggccgcuugggaagcgcgggaaucggugugacacuguggguccucggagggagagcaggaagggcguccggggcuguccccgaccucacaguugccgggcguccgggugguaugcgcccggcagauggaguuguuggugcuuagcugacaguaucugcccgggagaccccgaguuuaaagguucccuggcacagacccgccucccgagcccuuagggcauucgucugggccaucuucgauugucgcgcgguucguacacuuugaucacgaccaggaaaugcagucugcgcacuccugcauuccucacgcugccaguacuuucggaaaaaaaaaaauaaagcauaacaacaacaaaaacaaaccacuucuugagagcgacuuuugcuucuuuuucagguacccucaaaaaguuauggauaaaauucuuaguauggcugaaggcaucaaagugacagaugcuccaauccauaccacacgagacgaacugguugccaaggugaagaaaagagggauaucaaguagcaaugguuagcagaucauagaugugaacauacauaggaguuuagaaaauaugcuuuauaaaauuaggaaucgcugucauuacuaauuuuuuuuaacaauccagaauguguaugcuguauuaaucuaguuaaaauguuaaagcuacacuguguguguaugugugucugucugagucugucugucuguuuuggugcugaauuugauuaacuuuuagauuuucaaguccaaugucugaugcuguuaauuuaauauuaaaaacuaaucauauuaauugauacuguuuuaacauacuaaugaaguuguuccauauuuuaaaagaaacuacugguucugaaaaaagaauuuuuuugugcuuuuguuugucuuguuuuguuuuguuuugauaggguuucucuguguagcccagccuauccuggaacuugcucuauagaccaggcugaccucaaccucaggggucaugccugccucugcuuccugaaugcugggaugaaaggcacuuugcugccaccccacucucugugauuuuuaaaugaauguuuuguugauugucaugucuuuaggacucuuaguaaaauaccuguguuuuucuucuuucuagaagggguagaggagccauccaaaaaacgagccguagaaggaaaaaacaauucuucaguugagcgagaucaugggaaaaaaucugccaaaacggaucguucagcagcucagcaagaaaacaguucgccguccagggggucguccaccaaauccgagaguggugggaccucagcucggagcagcuccaguggcucccaucaggauagcgccacaagugaaggagacagaucugugugcagccagagcagcagcaauuccucucagguaaccgcagggucuggaaaggcuuuggagucagaagcuccacauaaacgugguucagcgucauuuguuucuucccuguugaaguccaguaugaauagucauaugacccaguccacugauaacagacaacagagugggucaccuaaaaagggugcucuggaagguucuucaggcucagccucucagagcagcucagagauugaggugcccuuguugggcuccucuggaagugcagaaguagaguugccauuacugucuuguaagucuaguucagagacagcuuccaguggguuaacaucuaaaucuaguucagaggcaaacauuucaucaucaguuucaaaaaacaguucaucgucaggcagcucuuuacuaaccccccagagcaguuccacaaauccaucgcugcugacauccaaaagcacggcucagguagcugcuucacugcuagcgaccaaaaguggcgcuuccuuaggaagcgugucucagcuagcugccaagagugguucucagaguagcacuucacaguugccuucgaaaaguaccucccaggccagugagaguucugucaaguuugcuugucggaaguuaaccaaugaagacauaaaacagaagcaaccuuucuucaauagacuguauaagacgguggcguggaaguuaguagcaguugguggcuucagccccacugugaaucacggagagcugcugaacgcggcuauugaggcucugaaagcaacacuggauguguuuuuugucccacugaaagaacuggcagaucugccucaaaauaagagcucucaagaaaguauugucugugaauugagguguaagucgguauauuugggcacuggcuguggaaaaagcaaagaaaacgcaaaagccgucgcaucgagagaagcacugaaguuauuucucaagaagaaggugguggugaagaucuguaagaggaaguaccgaggcagcgagaucgaggaucuaguacuccuggaugaagaagcaagacccguaaacuuaccuccagcacugaaacauccucaagaauuacuguaacuucuccaaguaggcacugaauccaguaucugguguuugaagagaaaaacuggcuuuuauauaagacacuggcuuucacagauuuuauauugcuuuuuuccaguuuugcagaaaauuuaaauucucguucucuucacuaaaguagagcuguaaauaauuuaugacagugcauauuaaaggguguacauugacagcauaccagcgugcuguuuuauuugcugaagaaaauacuaucuucuauuuuuaaugauauauuagguacgauguguaguucuguagaaucuuaaaauuuuuguacuacuacuaccaauuugguagaaauguauuaaguugucuaccaugccuuuuuuuuuuuuuuuuccuaacuugauugaaucacauaaaagaagggggaccacaguauuugaaugugugaaacuauacaaccuaagguuuaaaaauguugcucaugaugcugaacagcucuuaaagaacaagaagaguugucucaaacuauuuucaugaaaagcuguaaacuuuuuuuuagauauaaagcaguauaaaguacuuauuguuauuuuauucuaaaguuguuuaaaauucaccaugauuuugacggcugcagauucuuaagcagguuaauuuauguuuugagguaaauuucaauuuacacuuuauuaagacauaauguugguuucuauaggaagcauauuuugugacuacuaugaacagacugauuuguuuagauauuaaaugcuuuaagcuauuuuaccuuuucaagaaguuguguuuuuuuuucuccuacccuggucauaacuaaggcuccucacuacuauucaaacuacaaccaaguaguuuucauaguauaaaacauauucuuauaaauagggaaguuuauaucuagaaccgggugguuuuuguauuuguagauuucagaagaauauggagaagacuagagagcuauggucaguucuuuaaugacuguguauucauguggauugcaucuguuaguaauauaguagaaucuuguuucugugucuuagguaauucuauuaaucugacaugguuuauuuuaaaagucuugucuaagguauaugacuuuuggccuucuggcuuucuaggaacugcacacuggacaauaauggagauaauauauguagaaaaagaccuuucauauuuacuaguuauauugguauuggaagguugaacauaagcacaauuuaaguguguaaaaauuaguuuguaguuuaggaauaauaaagacacuuaauguacugaguuuaaacugaaauaaucagggauguuuguauuuugccagauaacauuuuuaaauuauuuguuuuuuuuuuuguuuuuuuuuuuuuuuugagaauagcucauuggauaccagagcaaaaucuauauucuguaaauggucugacugcccuuauauaguguggaaaacacuaacauaagugaguuguaaaaaacacugucaaguuucuucuguuguguauuuuguaaacuaaugcuuaccagaaaagugagccaaaaauuauaauaaauacauuuuugaaaua

SEQ ID NO: 12422 - RNA, 3202 nt, Mus musculus
auauaacauauauauauucauguuuaagaggaagaauaucaaaaaccauuaaaaaaacaacaacaaaaaaaaacccagcccagcuucccacccuccugaaguggcccccauucccauaucaguccgagaagaccugggccagacagcuguccccguccucuuaacagcccagccuacucaaaaguuguuggcaagaccaugaggcgacagaugggccccucuuggccucugucccagcucccugcagccagauggaggggcgccugccugcuuccccaucccugaagcauccccaaggacaacccuccuuccuccaccaugaugaggggaagcuggagcccuaagcuuugauccucuauuggaguggcccagaucuuuccaucuggaguaagucuauguuagaagccaaaggccuucuccccagucuggccuuggccuccagccuggaaaagggguuaucaucaguucugaaggccaaggccaccccuuccccaggacagaaccacaucucugauaaagguuuugacgugaauaaaguuuuaaaaaugagcccuaauaaugguucaugccuacuggagcuucucacagcuguuugugagucugagcuagccgggggcacaggugaagugggcaugcugagaaacggggaggagccuaggagccuuacagacgggccccagcaucuccucccucuggaaacuugggccccugccucagcucaacccuagaaggacugcugcuccuucuaucaugcagucuguuuggcuguacucccccugguaauuggcuaauuacuggagauuaauguugguaaacagaagccuccuccucuccugccaucugcuccuucauuauuugcccauccauuccccuuucucucuccccaaagccccaguucauggcauggccuaguguccaggugugaacacagccagguggagggauucucccgcccagguguuggggaaugagccgggcgacccaggaagucacaacuugagggagaauguguagaauauggguugucagcagcuggcuuuauugggaagggagcuuucaggagcuggguucaccagacacugcugaguccugggcuucagcagaggccauagcagcaauucgugccuccuucuucugucguugucuuucuuccuuuaggcgcuuucguugcugcuugucuagguccuguaauaguuccuggaagcgagcacuccuuggguccacgugguagcccaggcguuccugggccucagccuguaaccgggcccuccgcuccuugucagccugaauuuucucccagcguucucgcuucugcuuucgccaguuuucaaucauuuguggcaucuuggccaugcacucugcgauacgcugcucccuguauaggaaagcagacagugagggcagaccaaggcaaaucugaauuucacccagcuguuuaguaaaaccacucucaugcccuugucauggauguccucagugauuccacaugcuuguacgccagguccaaauucagggacagggacaacuuuuuuuccaguccugugaaucuguagguacacugauaagauuaggauaguaaaacugaaagaacaaguuuuaucagcuagggugggacagaaagggggaccagcuccauccuucaaugccagcaugacucuagauaucugacuugacuucuucaggccucaguuucaucuguaaaaagggucaucuuguccuuuuaacauugugaggauaagguuaaauaccagcaacacauuucaccagcccugaacccugcaccagaaggggcgauccaaaugucugguuugccuccauuuucuccucaaaucugaucacaugugccuucuuuucugacuucuaccccagacuucagaguccaucacugcucucaggucccacuaccuagcuacgguggccacacaagacagggucucacuacauagacuaggcuggcuggccucaaaacucggugaucuaaccugccugucuccagaaggcugggauuaaaggugugcuccaccaagaccagauuauuugugauaaaagguuucaccugggcuguucucuaauugagaaucaucauucccacuucucaaccucagggccuuugcaacaguugcucccucuacugggaacucaugccuugagauuuuuccaguaacaguaucugguuauauggggauuugcuuaaacaucacaagagcuagcaugcacuuuuaacuguguuugucuuccuugggggggggggguuccucagucaucauccgaauccucugucugcuuuguucccugguguguggguccuuauauccuugcagaguaacuagggaaguauauagaguugaggcugggacugguacaggccuguaauagcagauauucagaagguaaagacagauggauccuagauucgaggccagccugggcaauaaaaugaguucugguuaauugaguccuugcuauuuagaauaaaagggcaggcuacugauaaaggaagaggacaaguaaaaacaaacauuaaaacugcaguugaggccgggggugguggugcacgccuuuaaucccagcacuugggaggcagaggcaggcggauuucugaguucgagaccagagugaguuccaggauagccagggcuacacagaagaacccugucucgaaaaaccaaaagaaaaaaaaaaaaacaaaaaaccaaaaacugcaguugaaugacuacaaggaugucugcuuugcagcaaaguuaacauguaauguuuaagcccacgccacaagggauccgcgugccuacuacggaugauuccugguuucggggcccugggguacgugccccaucacacccaccuggcuuggcgccuugccuccaaggccugcugcugcaagcgcagcgacucuugcauggucgcuaagcucggguaccauucuugcuccucggccuccaacucgcgcagcugcucuggggugggccacagggaggccgggggcaccccggagauggcgccaugucguccgaacugcuuggccacauagcggggcguuagcugccaucgcggggucagcagguucuccgggucuggcgaguggggcccgggacggcggcgcgggggcgggggcgcacgguagcugcgggaccugggacccagagccacagagagccgcaggagauagccacuccgcauugcgagcgccgccaucuuggcugug

SEQ ID NO: 12423 - RNA, 46386 nt, Mus musculus
ugccuguuaauccguuaugauuuauuagcuguacagcaguagauccuccuccccagccuucaaccccauuacauauuuuauuacaggucucauguuggcauccuaaaauaaugaaaaauaucacacaguacagcuaaguacaaaaaugcaucaaccuagauucugauagcuaacugauggcucucuuaaaagcaauacacaggagaaaaaaaguguuugaaaucagucagacugaggcucuuuaaaaaacacauauaauaugugacaauucaugugcaagaaucacuuuuuaaguugguuuguuucacauuauuaauaauuuuuuuuccagaugugaaguuuaaauuacugaccuacugaaauuuuuuggcccagcuugccaggguugcuguggccacucauaaucaacucuucuggcuugaacagagauuuuuaaaaaaauguaacauucagcuacaaacagagcaaagaaaauguugaugagaaaaucauaaaugaaauuuauuuguucaagguucaaacgcuggcuccaugagcuggaaaucaggauuuuucacauggguguccaugacuggcaggcaacaggcccagugcccucugcuacaugauugugauccgagucaacauuuacauaccacuaagucugugucuguggcaccuuaauuugcaaauaauuaaaaugcuggguuuucuuacacuguacuucuuuucaaccucuuaauuaauggaaaagauuaaaauguaaaaaagguuauuuacaagcuugaccauaccagaaacuuugccaagaaagaggcaaagcuuucaggacagaaacugaucguagcaugccauccuacuggugugcaacugacucugagcaaagggagucaggaaaagcaaaagcaaaaccagguuaaaaguccaaguccuucccaagucugcauuuacaauuaaaaauucucuugggaagaccauagaacucugggaaacccguggccguucuggagugguuuacgaucaagagagagggcucaaugucucuguuuccaucuaagaaaacuaguuaggcaucaacacuguccucaacacuucacaguaaacccucagagacuuagaacauuccaugauuugcuaacaucaaacaaguucuaguuaaaucacauuuuucuaacaucauccuugaaguuuucguucucaguauguuugguaaaaugguguaaaauuaugccguucccaaagccaaagaaaaaaaagagaaaaauuaagauuugggccguuuaaacacagcccaauaguccuggugccgagcaaggccccagcaucaccgguccaucaugcugaggaucaucucaggcgugaggucuccguugggggcgucugugguggcugccugagccuccucuucuucccccuccgcaggcucggcaucuggcuccuuuuugacuucaacuauaauguucucaauugcaccuguauucugaucuucgaccugaaugauggcuguugcuggcaaagaagggcaggaacaaaacaaaggguacguacauuaaagcccccagcgagcacaggcauuguucccgaugcugacaaugaaugggaugcagcaacaagaaagccucagcagugaugcccaagucagcagaaacaaaacagcccugcgaacguuaaguggccacacauaaaaucccaaaaggcuagaaauugucagauaccaaauacugacauuuaccucacaggccuccacuuuaacauuuuuaguuuuccuuuauguucuguauuuaggauguauaguaaugcagggcagggaaaaaaaaauccagcccuagacugcacaugacaaggaguauuucacagaguauaugaugcaguugacauuucugacccuguacugcucugaaauaguuguguguaggugaaaugacugggcgguucuagaugcagaguuaucccccuguucugugauggacauuuggacauggcgcucagggagcauaauuauagauuaagcccugaauuuaaagagaagaaaaggcugcuuugaggcgaucuaagacccacuacauccaggcacugugcuagaaagggaacacuccugggacaauccuuucaccugaaugguuuccccuucccuucuucuuuccauguagcccaggccagccucagccucccaaguguugggauuagggcugguaauagcacucccggcuuuaggggccugaguuccuccagcagaacugucucagucuauucguugcuucagcccuucauucccugaaagccuggcucuuuucuacuuauaaccaugucagcucugccaugugacugugaccuugguuguuuuauaaucgcucccaaaauaacagcacacccaucuugcaggacauuaguacccuucuccucuagacuuuuucauuuguaacaggcuuuuagagacugccucagauguuucucaguaaaaaaacaaaaaaccaaaaucaaaaaacaaaacaaaaacaaaaaaacuuccuuaaaaaaccaaaaaaccaaaaaaccaaaccaaaccaaacaaacaaaacagggcuuccugagcaucugugccuguguggugaccuucacuuguucucaaagcucagugcccaucuucacaaacacagucugcuuccucacaugagaugcucacugagccagggcaggcaacuuacgcugguucuguuugggcugguugguucuuccaggaggucgcccccuucucuucuuggcaggugggggggccggggccacaggcugagguggaggcggaggcuggggcugaggcucuggcucagguucaauuucuacagcaggcuccuccuccuccucauugucaucgagauccggcucagcauuuucuucucaagaaaucaaagcacagguagugggucaagcagagugagugguaaaagagaaagcaagcagagaguuaaauguucugaaaacacuguuuuauauucccuuaaggaaagguugggcacggggggggggggggggggggguagagcaguuggggggcagaggcaggcagaucacuguguguucaaggcuaacaugaguuacaggacagccauggcuaagaagagagagccuguaucaaaaagaaaaauaccuacuuccacauuucaugugagcugcuuaguguaagaauacugaguacucauauaaaaguauacugagucuaagaauaagaaugccacauggugauagaauuaaugcuuuaauucuagcauucaagagucagagacagguggaucucagagcuuaaggacuacacagagaaaucuuguauuaaaaaacaaaaccaaccaacaaacaaaaaagcugaguuucaaaccauacagacagcuucaucuuuuaucaguuauguaacaaacuacaaaauagcccuaaaguaaauaauaacaaauauuucucuuguuauacaaaggcagagcaggagacugagcuuaaguugacgcaugaagacggagaugcucaucucugacuggacagaggcaggaacauaugagcaugugcacacacccaccuauaugagaaggaaauacagaaacugcagaugcaaugagaauccuguuuaccagggcaagaggcaaaguucugggacuguuuucuuucucugauccucuuugccuccaacuccuaaauguauagguggaugccauaacaccuacuuaccgcagugcuggggacucaacucagagccgugcaugcugggcaaguacuacugagcuacaucccaccuuuaaagcuaugaaacguaaagggguaaaugaagggaauacuaacaaagaaccagagaguaaagcugugaagccucagaccucuuacauggugacugacuugacacaccuacccuucacuuccucagggagugucuguagcgcccacccaacagugcuuugaggauuaagacagcagacaauugcauaugguaguguguguauauauauauaauucaguucaugaaaggcugagguaagagaguggggaguuuaaagccacccuggguuauauucuauauaaauacagccuuuauaucguccacuacaauaaaaaguccuuuuuauuagguuucauuauuucaguuaagaggauguauccagagcucgggagauagcucggcuaguaaagugcuugucaugaaaacccgaggacucgagaauuugaucaucaucacccauauuuucuuuaaaggccuuggagcugaaaggauugcucagugguuaagggcacuuccugcucuugaguucaguuccuagcauucacaauagguggauuuaaugauuugggccuccacugaagucugaauucaugccacacaccuauauaaauauaaauguguauuaaauauaaauguguuauuuccccacauacacauauuauuaaaagguuaaauacuaauaaagagagccuggagugaugauaugugccaaauaauccuaguauuugggcaauuucccaggaguaucccgggggugugaccucuggucuacgcaugcaugagcacacacauacacacagcacuguccuuauuuacaggaaaggcgagcagcucaaacugcuguaggugggauucaagccucugacauucaucugaggcagcuuugcugucaacacuuacaggcagccagaaaguacuuaguaacccuugcccaguacuauguguggcacacaggguacacugucugcuucccuccaagcugcaugacacucauuaacacucauuauuaacacucauucacugaguguuuaaaguuagagccaugggugaaugccucaucugaagauaaaaaugcuucauguuccaguaacugagguccugagagacagaacacacuguagguggcaguauaucagaaacaagaugcuuccuuguggaacucacucaagucuccacugcccuaugccuagaaaauuaaacagauacagccagaaaugggggaaaugcagaaaaaagcuaacaaggucaaaaggcuuuuggcuuugagaaaguuuggaauaauucuguggucaacccgugcagauggcuaacagaaauuauaguguaaauaaggcucuauggccuucacuagaauaggauagaguccagauugccuccaguguucuagugcuacguuaucuguaagaccuaugagugaaaccagcggugaagucagaagaaagaacaguacagaucuaguagaggcugucaguaguuucuucagagagagaacaugaacauaaugaagggcaugguagguagcagggaaagagaagacaaugcagagucuacagcagcagggagcacugcagcaaacuacacagcucugcaaccucaugcuuaugucaucacuucuaacuucgggggcucaucugacauuucagaugccaaggcuagccuugcacuugcuaaggagagucuggcaugggaacucugcuuugcucuuccggcuucccccuccgugaguagcaccuggcuuuagaaagauuccaagcauaaaggagaggggccuucuugccucuacuaccuuacacagauuuacugaaaacugggucucugaugugucaccucuaaccaaaucaacaaugacccacuuaccacugucagaggagucuucuuuuuuagaucgcaucuuucuuuuucuuccucguuugcucuucuuugucuccccuccauuuucccccucuacgccaucuggaccagcacaguuaucugcaugucuugccauuguguucugacaaaaggaagaaaccuuguuucacacuacuaaaagaacaaaguucagacucaaaguucucuuuaacugaacaaaaacaaacuuuaaggaauccauaaagucucaaaauucugcuaacuguacucaacauguuccucccauccauucaggaaagaugcacagcaucuguagucaucagggaugggggaggaaacagaaagaggaaaggagcgaggaagcaccaguaagaaggcugggccccgugcacauggguguauggggggcugggguuggggcuggggaaggguuugagcucagugccuguagucacacagaaacuugggggaguuucagaauagcugguuaguguugacuuggcuaaucaacagagagagccgagucagauuaauuagggauaggaugaaauacagauuucaauccacgcaaggaaaugccuuuuuacucucagccuacucaagucaucuuauuucuaaauauuugacaguuucaacucucauaaagagcaauuuuaauggguauuuaauuaauuuauuuuuauuuaauuagguauuuucuucauuuacauuucaaaugcuaucccaaaaguccccuuuacccucccccccacccugcuccccaacccacccacuccuacuucuuggcccugagguuccccuguacuggggcauauaaaguuugcaaguccaaggggccucucuucccagugauggcccacuaggccauccucugauacauaugcagcuagagacaagagcucuggggguacugguuaguucauauuguuguuccaccuauaggguugcagaucccuuuagcuccuuggguacuuucucuagcuccuccauuggaggcccugugauccauccaauagcugacugugaacauccacuucuguguucgcuaggcccccaggaauaacuuuucaaauggcaaaaguaucccuacauuuauuacuccaguggccacaacuccauucuguaacugaagaucaagugugugcuauuaagagccauaacaggagccugagccuuacccggcgggugaauguuuucccacacuuggaacagacaaaggcagcagggacaaaguugggaucaugauagcgcuugaaaugcaugucgaggagcuguuucuggcggaaggucuugucgcaguggcugcaggcauaaggcuucucccccgugugagugcgcuugugcaugaucaugugccgcuccugaaacagaacugcuugucagaaaggccuccgagagucacagggcuaucauccuuaaggguuaacaauguuugcugugaugguaacagucuuuucauagggaagccaaaguugucccuaaaaccccagcagagaaagcugcucacuccaguguaagaaucauuuuggggccagacucuucucucaagucuuggacugaaugcccuugggauuuuuuugguuugcuuuuauuccaggcauagucucauguagccaaggcuggacucuaauucacuauauagucaagaaugacugccgggcggugguggcguacaccuuuaaucccaccacagaggcaggcgaaucucugaguucaaggccagccuggucuacaaagugaguuccaggccagccagguccauauagugaaacccugucucaaacaaaaacaaaaaaaaaaaaauaucaauugugaccaauguauauguauauggagacccagauucaaaugauaaagaguagcaucuaugauuccuuauacuugucugaaaaaucuucuuagaaagaguuacuagguugggugugguagcacacaccuuuaaucccagcacucaggaagcaauagucagauggaucucuaaauuuuuuuuuuuuaaagauuuauuuauuuuuauuauauguaaguacacuguagcugucuucagacacuccagaagagagagucagaucucauuacggaugguugugagccaccaugugguugcugggauuugaacuucagaccuucggaagagcaguugggugcucuuacccacugagccaucucaccagcccggaucucuaaauuuaaggccacccuaauguacaaagagauuacacaaagaaaccauaucucaauuaaaaaaaaaaaaaaaagaaccaccauacuagucaugauacuugacauggauagagcaucaauggcuuuuuaacuaacacagcaccuaccugucuacaagcauaaucacacuggucacacuugaagcgcuucucauuuuugugugauuuuugaugcuggaugagagcauaucgcucaugaaacacagcaucacaguagcgacauuuuuugcccuguucaauauaggaaugcugcuuucgcaaguggacaccugcaaacaaaauauaaagccaagcugaacuuggaaaaaucacaaguuaaauauuucaauaaauuaguacuauauuuaauuuacuucuuaagaacaugagaucagaaguaaaaccuuugguuaguaggugagagccugagucagacccuagugcuguuucggccccacccuucuccuucuccauccaacaguaacaacagauggggagauaacaggucaaagauggaagccugaggccugcacuggacccggaagcaaucguaagugcugaggaauccaggaagugagagcaauggagcaauggaggucagagacuaaaugugaggaaaggcgaagaguaacgugggugcuggacauaacacccagugaagacaaagccacguacugaggugaggaguaguggaaagggauuaaggccaagcugugucuguucuggcagggaaguguaggucauuccagaccuauagucugacagauacugaaucccaaacaaugacauuaaaauagggaugggaacagaaaaggauagucugguacuaaaacaggaguggaaccagggaguugaugaggucacuaagacaaaaggccaagaguaagaacucguauggccaggcuuguuucacuguugagucagggucucuaugauucaaauagcuuacaauguagaccaggcuggccuagaacucacagauaacugccuaaccaucuucugaaugcugggauuagaagccuucaccaccacacccagccuggguuaggcuaagagucagggccacugagaagagggaccaguuuuaaaaaggggggcuaggggaggaacuaccaaagagagaaacccaagagcacuuuaaucauggaggccgaggaaaaaaaagugcuuuacagagagugcagugcaccacuuguuuguugggguaaggcacuguuagggaagcauauaaaaugaguggaguguuucagcaaggcccuuuacuggagugccaguagauagugcaaaugaaagggaugauaaacacagggaaggaaagacuacaagggacaaaacuguucauuagggcuggcugggaggaagggaguuaaaccuagggcuagagauguaacucagugagaaacagcuuaccuaucacacaacaugacccagauuuaauuuccagcaauaugggaugguauggaguguguaugaguguugugggauacauuuggaaaaacucaaguuauuuuaaaaauguuuuugugguacuaaagauugaaugcagggcccuacacauaccagguaagcacuugagcacucagcuuugucaccagccuucuuuuuuaaaaaaaccuuugagacagggucucccuacauggguaaaggcauauccucuugccucagcuucuugaguagcuugauaacuugucuauaccaugaggccuuauccaaaauaguucuuuuguggauaggagagaaaggaguacaccaacuugaaaagaaagauccaggaguacgagagugaagauaaacaaaauaauaaugaaaaccugucaggaaaacagaaaaguggggcugagggugaagggacaaagaacagauaaagaaagucacaccaacuccuaaagauggacaggaaagaugaagguaaauauagauacaaggauauuauaguugguuuuauaacaggaaauuucacccugcugccuuucuauccuaagaagaaaaaccaggaagguuaguaguuaaaagaaagggaaagacuuuucuaacucuacugcaucauggcaccuccuacagaguagagccaaaggaucugugccacaaaugaauuaauauacuaaggaacaauaggagcagcccugaaagagcaagucggaggacugcuccggaggagagcagcccauguugggauuauaaacauaugauaugcaaagccagugucucuucccuaagagaaacuaaaacccaaaaagacgagaggaccaauucuauggaccaggcucaaucccagcaugggagguggggggaagagauagaugguacacacacuucauacacucaucucugggcucagaggcugcagaaggacaucaguguccggcuauauuacucuucauguuacuucugagauggccuggguucaauucccaguacaaucaacaaaacacaacaaccccuaaagaucaaaauaagacaaaaaacaaagcaaaacaaacaacaacccgagggaacucuggcuucugcccagcuuugccacucauaaauuauauugaacaucugguacaucuuugugagcauuaaacucaccgcugugguaaaacuagauacaccuugcuuacuucauacuguaaagaucaacuguaaacagaaaaaucuaaaccacaaaaauguaagugagggcuggagagauggcucagcgguuaagagcacugacugcuuuuccgaagguccugaguucaaaucccagcaaccacaugguggcucacaaccaucuguaaugaaaucugacacccuucucucuucuuuggucugucugaagacagcuacaguguuuacauauaacaauaaauaaaucuuuaaaagaaaaaguaagugaauguaaagaguauuucuaagaauauaacuuagugguacagugcuugacugcuagcagaugagaggcucuggcuuugacagucaacacuuaaaaguucaaauauguucaggaagcagugaauuuugggucgagagcacagacugaguaguauuuaugauuuuuucauguaguaaagcagagccuacuaauuuggcuaaagcuaggcuuaaacuccccagaaucaaaggauuccccugcuuaagacuucugagaaacugggaccacagguguuugucaauaaguaaucucuuuaucuucugucuacgacagucucacauaacccagucuggccuugaugcuucugcuucaacuuuccaaacgcuggcacuuacuauuccugacuucuauuuuuuguuaguaagaaagaugaagcgagaacucuagaugaucuaaugugcaaguguguguuacauuaaaauuccuauagaugaauucucccucugcuuaacucuggcuuaccaauacauaggaauaguuaccaccaaaccaauuacucacagaaugcacaaauacucuugaacaaccugaaggaaccuggccuuaacugaaaccuuuuccgucccuguuuagagaauggaagcuacuaugacaggcacacugcuucccauuacaguucccauuaccuuauguauaaucuauauuuuagauagauuuaacuugugguuucacuccaauaaagagaaagcagccagggggaggaggagcuaagcaauggcaucacuaagugguaagccauucauuaacauacacaaaaguuugaguuuaaggucaaguuuuuaucuuguuuucaugaauucuuuguuucuuacugcuacuuacccaaaucacuuuuucgggcuaugacagugucacaauggggacaaugaaauuuggccacauuuucugugugcuucuguaaaaugugcaucuucaugguaccacucuggguaaaccgagcgugacaaauauaacauucauaagguuuuuccccuuaaaaggaaauacagaaugaacaaauuaaaugaaugaauacuauagcuuuagcuuuguaggugaauagaggaaugguagacaaauauaaaaccuaaguaaggccuugacugagaaaauaaaacuugguguaauuaauuguucaacucauaucuaucuucagaauuagcaaacaaauccuagaccuaagcucagcuuggcuuucuacacucuucuauuuuaggacaggauuucuuauggcaaagcuuacuuugggcagggggacuagaacuaaauuguucuuucucuuuuauuuuauuuuuuuguuuuucguguagccaacucagaaaucuaccugccucugccuuccaagugcuggguuuaaaggcaugcaccaccaugcccggcuucucuuuuauuuuuugaagcacggucuuguccuguugccuaggaugguuuggcaccagagaugcucuuacuaagugcuaugacacugagcacaagcuuuucuuuuuauaaaaugauaguacuuagaaaccagaguaaauuggauaaucuauccagacauaauuuuauuuuuugaaacacaaaacaaggagucacuaugcagcccuggcuagucuggaauuugccguguagaccaagcuggccucaaauuccaaauagcugcucgccuuugcugggauuagaaguguguaccaccacauccagcuucuacccggauuuuuaaagauaaacaugagauuuuaauuucacuugaugucucccuuaaaaggaccauuuucacauuauaagacucaaauaaaaucgccuuugaguguauuuucaaaccaucaauucagaggauauuccagagcuuuucuuaauagucuuccauucagguaagcccugggugcacauggcaguuuacaggauucacugaggagcagcucauuaguaccaggaggggagaaguccuaccugaauggguucucauaugccuuuucagcuuguaugugucccugcuggcauaacugcacaaacugcacuggaacgggcgcucuccaguaugagagcgaaugugucguuuuaauuugcugaccugaaacaugaaagcaaccgaacgaaccucuuauacuucuguuaacauggacuauaauaugaacucuauggcuuagguacaaaaccuuaauuuggaggcacuaaaguuaaagucccuuugcuuccucucagcaauauuauaauccaaggagacagggguaaauugacaggacacacauuaggcaaaacaggcacacuaauaauugaguugaguugggugguaaggcacaugauaguauacuaaucuuuaccacuuaguguguguggugauggugguccuaaagauugaacccagggacuuguauuaggcaagagcucucuaccacugagccacaccuccagcccuuuuauucuauuugaaaauccacaauacuuuaguaaacaacucaugccauauacauacauauauuuccuacaaaauucaacuccaaggucauguuuuaauuccccuacaagcugucaucucauuuguauuuccuagacaggcugagauuuaugagucuggucucucuuccuugccacucaccgugcuuuccaucucuuaguaaguacccuaucccaaacuauaaguuucaaacaugacucuaaaaaguacuuuggauauucauaauaucucucugaaauuuuuggaaaaauccuucugauuuuaagagaaaccucucccauacccaugagaauucuauauuaacuguucucauuuguucaguggucaaguaccuaucccugcaguuuccucaaugccugcuccuuuugccauguucaggauaugccaaacgcaggcuaagagugcucuuccacucacaguaguaguaccuuguccccauaccugccugauuuaccagagucucacaaaucaacagaacacaucucucuauauacuuucaaauuuuucuuuaacuuuucauucacauuuagucuguugcuaaaacuuuggaaucaacuuguaaucuucacuuauuuaugcccuuugcaaaaauguguaaccuuuucugucuaaagauacaacagagagcugggcaugauggaacacaccuuuaaucccagcacuugggagguggaggcagguagaucucugaguuugagaacagucuagucuugcuuacagagugaguucuaggacaaccaagggauacaccgagaaacucugucucaaaaacaaaaauuacaaaaaugguuuuuacuguuauuucaaucauuucacuacuaucagauuuggaaccaccucaagguuucauaguuccuauuauucuuaguauagguggucuaacuccaauugaaagagguuuaaaauuauuacuauuuaaauaauuaaauauuauuauuaauuuuaaauaauuaaauauuauuacuauuuuucucuuuaacaguacuggagacucaagacagggccuaguauucuuccacugagcuacaucuacacccagugucccaaauuaaaaaauuuuaagaaccaacacaucagcaaguagcaaauuugauacugaucuuauguggugggucucaccgaaaacaguuacaccauaaguaacugcauaaaauuacaucucugugcacaaacuuaugcuuacacuucagucccuuugccaagauaucaguauauuuauacaaauauucuaaaauccaaaacaaggugggguuggagagauagcucagaucagugguuaggacuguccaguguucuuccaaagauccauggcaggguuacagcagcucacaacuaaucuucugcaacuccauauccaagggacccaacuucuuguggcccuuugaacccaaaccacuccacacauaauauaauuuaaaaaauaaaaucuuaacucaccaacccccaacaaauaaccacaaaaaucaaaaccuggaagaaaucuucaagcaccuuugguguuaagcauuacugguaagagauacacaaccuuuacacuaguacgagauguuuggaaacuggagacacagcucagugguugaguucaugccuaagaaacuggguucaaacacuggguucgugcaaaaaaaaauguucauuucuauauacuuguuguuguugagguaggguuucuuuguguagccuuggcuauccuggaacaaauacuguagaccugguugagcucaaagucauagagauccaccugccucugccucccaagugcugggauuaaaggugugcaccaccacugcccggcccauacuuuuauauuuggucucccuccauugaauuccucuaaggucuuuuacugcuguauauucucuaaaauuaaaaaauaaaaauuuuuaagaaaugauguuuuaaggccugggaaaaugacugaguaaaucauuuacuaaugauagaguuucaaaguaaaaauccaaagggugaaagaaaaacugcuauagucaaggaucggcaggaagcauccccacccccaacccaaauagaaaaauagauaagaaaaaaaaaccaaacagcuggguguggaggaacaggccucuaaucccaacacucaggaggcaggggcaagcagaauucugugagcuccaggccagccuaguauacauaaauaguuagaccuugucucaaauaauuaaaaaaucguaauuuuugucuacuuguaacauacucucuucccuuagcuguaauucucaauacaacaaugaaacaguagcauucagauacuagaugaugaugaugaugaucugagacaagguuucuaaugcuuaggcuggcuuaaagccugcagcacuccaccugcuucagccuccccacugcugagguuauaggcaugauagaucacuucagugauucaguuaauuaagagggauuugcucuggcuuuucccuagucuuguuggaacuugacacaguaaugagaacugaauuuuauuaccccucuuccagcucccuauaaaguaauacacacacugcugaauuaguuuuguuuuggauauacuucaucacuuauuuuucaauauaauauuugauuugguugcuuacuaaugucauguaaccucccccuuuguuaguauccuuauccaguuuuggcaauagggaaauucaaauaauaaagccaauuaucuuuccuacaccccccagccccuuuuuucuaagugaugggaaucaaacucagaggcucaugaacucggcugcuuggcaagcacuguaccacucaucuauagcuccaacccuaaaccuucuagcacugcauuuauuaagacaggcucuuaacuauauuccaguugguuucaaacucaguaucuaguccaagguaauuucaaacuaacaauucucagccuguccaaugcuacgaucaaaaggguauaccucauccgcuucugguuccuaaaugaugugauuaaaggcaugaacuagcaugcucagccuuagaauagguauucuuuagaacaaacaaaaaagcccaccauagucuaagagagcucucaauaauaaagaacuagacacucacuucuacacuggcauaaucacacauggaacacuuaaaugguuucucaugaguguguuuauaacgacgaugccgcaccaauucuccacuggucacaaaggccauaucgcagucugggcacuugugaggacgaguaccuaaaggaaggagggaauaacaggaauuaauggcacaauucaugacaggguucaauguauggcuaccagcucuacaagcuacaggagcccuggauaaauucucaucacuagucccuaagaugugagaacacaugcuaaacuuuaguuucugcuaauuaucugauucuagugccuuugaauagaaaaauccuuauuucuguuuugcaaauauagugguuacuaugaauccaaccauuaauagaaauuccaguguauuuuaguccuaaauauaacaacauuaagugggcagugguguugcaugccuuuaaccuagcacuugggagacagaggcagaguucggggauagucuaaguucaaggccauccuggucuacauacuaaguuccaggacagccagggcuacauugaaacccuguuucuaaacaccuccucccaccaaaaacaauuguaauuuggaaaaucacaaugucaagaauaagaaaagacaccugcagaaauuauucuuccuuccuuucaaagguaaggucucaauacauaaauauauaacccagacugaccuuaaacucuugugcccagugcccagccucccgagugcccagccuccugagugcuuagguucacaggcauaaaagaccaugaacaacucuacaaaaaugacuuucuaaaaagaugaaguaugaacagggaagugcugauggaagaauuacaguaagaaagaaauggaaaggaauggcuauucacucguuaaauuugcuucuucaguaccacuaaguuaggagagaauggagaaacucuuucuaugaagcguguauauauaaucugguggcacagaaaaauaaaacaauuaucaagggaaggaaagcagcacuaauuucaggaacaagguaaucaaaauaaugaccucugguuuuuaucuaguguuauuucgggaagaaaagaguucugucucugggaaacaaagcuugacgauuauuaagcuggagacuguuguggagcauccaucaggcuguacuacaagaccaccauguccucugcucaagguucauguucagcaagucuuuuuuuuguuuguuuguuugcuauaacuuuauagccaagaguacccacuagaagccuggcacugugguucaugccuuuaaucccagcacuauaagccaaccuagucuacauaguaaauuuuaggacagccagggcuauguagaagacucugucuuaguaaaacaaacaauccaaagaaugccuccuagaauguaauauaagcacauuuagaagaugaaaagcuuaucuucaucggaaguggcacucaauaugugcgcauuugacuuuugcuggcuuaacuaggugaguaacuaggugaguaaguuuuaccaagucuggacaaccacagaaugaacuuuucacagcuuaagcacaguuuaagacagaguacucaugucaauguguacacacugacaaauucuaccaauccuuaacaacauaauguuauaaaaucuuuaugaauuaugucagagaaaaacugcagguuacaagaagaaacaaaaauaauauucuucaacuucuuacugcaguaaucgugaauuaggaaccgaguuuuaaccuuuaccaugccguagcccacauuacuaugcagcaccuguguguguguucagaugauuccucaggagggucacuguucugaaugcucugccacacagauggcauuuguguggucucucaucaguguggcuuuucaugugacgauccaaauuugaacgccggggacauguguaacugcaaagcucacacuggaauguuuucuuuacaccuauaugcaaaacaaaacauaagacuuguuacagugcuucaauguuuagauuaaucccaaacuacaaugauauucucuuaacuuuuuauaaucaaagucaaucuaaguagaaauuaauucacagaauuaauacucacuucucuugagaacuuaaaaacauaaauaaaacccuucuuuuggacugauuaaaagccauggcacccacuagacauuuaaaaaaauuuuuuuuuugacaaaauaacuugcauagaggcuguuguauccuuuuccccaaaugguuguacaaguccauuagagauaaacucacuuuaccuuuuuuuuuaauuuuuguuggcuucggaggcuucauauuaccaacuacuuucucugcauuaaccucagacagcaguccuuccugcuguucuuccucaaaaucauacacagacacauccacgucuuugcccucuucuguguaacgaaguuugcucuuuuugguuuucuuuguuuuuuuggcugguggcugauagucugggucuuuuugccagcuagagucuuccugaggaggaagcucgcccugcucuagugucuccacuucuccauuggcccccacuuucaccaccugaaauccuucaggcaaagguaaggugugacauaucaucgguucacuuucugcaaggcccucuuuagacacuucauucucauaagcccccugaaguucuucuacugaaguaguagcaacagguaccgucacaggaacagguacuuggacaagcugaagcucuccuauguuaaugggcuguuccuccauauuuacaaccugcaagguuaugaucuggguaucguccacugcagccucugcuuccggagccacuguacccuccaugacuucagucuucaucuggagaaggguaggauccagcuguuccaucauuaccaucuguacacugcuguugacauccuggaccaccucacccccaucugucugguucuggggcagguggcaagcaucuucuuccuggcccccuucccggcgucucugguaagucuuucuuucuuuuccuuuaaugaaaguuucagacuccuccacaauggcuucaaccgccucaccuuccaucuccccuuccuuuauuaaggagaacacagauguuauuuaugaugugguuugcucaaaucaaagcacacauuuuaaacuaaaaucauuugaguggcaggugguaguggugcacacaccuuuaaucccagcacuuagaacccacaggcaggcagauuucugaguuugaggccagccuggccugcacagagaaacccuaucucuaagaaccaaaaaccaagccaaaccccuaaaacucaaccuccugaccccccaaaaaacccaccuuagugaaugaauuaggcauccaucaaugguuauuuaauagauaucuuccucuuugauggaagaaaaaaaaauucaccaccuauauuauaaaucuugccaaucaaaacaaaaaaaucugaaacugaucaagacucuagauuauacucaaaauuaacagaaaacuggugacagcagguguuaaauauacugcagaaguucagucuaagagaaacacuacaauguuaauuuugguuucuuaugcgaauaaacugccaaaagaaaaaacaaggaaaaguugaagcuacaacugagagaacuuagcuucuugagacaguuggcaaggucuaaggcuauuuuuuaguuguuauuacugagauguuauuaaugacaucaggugaaucacagaaggcauaggucagucuucuaccacaaagaacuaccagugcuaaguacuguggggcaugacuagaaagcuagcauguguacagcugagacuggaggaugaaauuugagaguagcuuggccacacaaugacacccaaucauaaacaacaaagagacaccagacuuuagaaacuuuaauucuggauauuuaauuauauuagaaauuaccaguaaagcuaguuaaaagcuuacucauuuggagcacaaugaagaauaaaaaauuucagucagaagaauaaaguuuaagauagcuauuguacacugugcagacaauaguuagcauucuacauaucuaccuuuucuuacuacaaaugagaaaauauauguuaaauuuaaugauuccucaacauauacacauuucaaaauguuaaacacaaaugcauuuacuuuuuucuuccaauuaaaaauuaguuuagcugggcagugguggugcacgccuuuaaucccagcacucgggaggcagaggcaggcggauuucugaguucgaagccagccuggucuacaaagugaguuccaggacagccagagcuacacagagaaacccugucucgaaaaaaacaaaacaaacaaacaaaaaaauuuaguuuaggggccuggagagauggcucagcaguuaaaagcacugauugcucuaaagaagguugugaguucgaaucccagcaaucacaugguggcucacaaccauccuuaaugagaucugaugcccucuucuggugugucugaagacagcuacaguguacuuagauauaauaauaaauaaaucuuuuuaaaaaauuaguuuaaaaaauacauuguagagaguagggcaugguggugcacagcuuuaaucccaccacuauugagucauugaguuuaugguuagacuacaauagauagggcuacauaaugagaccccgacucaaaaacaagaaaguacgcuuuauaucuauuuauaaagcacuagaagagacuuugcuugcuuuuaaauggcucugggugucaaauccacggccucacugaacuacacuccuagcccaugccuuccuugcuguuuuuccuaaauucucccuaaugaccauacuuugucauaccacuuuucagaaagcuuuauuguguggggcuaggaagauggcucagugggugaagugcuuucugagaaagcaaugaagacaugaguuugauccccaacacccacuuggaaaguugggcauggcagugugggccuguaaucacacugcuagggaggccugacugccucugccaucaugccugucuacaguuucugucucuugaaucuugguaguaucuagaguaaaguaacaguccagcaagaugacucagaaguagcacuugcuacuaaucguaaugacccaacucugaugcccaggacuacuguaguagaaggaaucaacuccuacaaauuuucuucugacuuucauguguacuguggcaugccugugugugugugugugugugugugugugugugugugugugugugcgcgcgcacgcgcgcgcgcaugcgcgcacaaacacuaaauaacuaagaacuaaaacaaacaaacaaacaaacaaacaaaaacaacaacaacaaaaacaacuucaugaguaaaacggggagcuggagauggcuucuuggucaggaguacuuauugcucuuucagaggacuagguucagauggagcucacaacuggcucuaacucaaguuccaggaguugcaauuccuucuucuaaccucuuggggcaccacgcaugugacugguauauguacaugcacgcaggaaaaacacccauacacauagaucuaaaaauaagcaaaaaaacuagcugacaguaaagugagucugauuuaaagcaaugcuguaaccuaacaaaaacaagagagagagagagagagagagagagagaaugugugugagugagugugagugugugugugugugugugugugugucccuaaacaauuuaaagugcuuuauguucuugguccagucucaaacaaagcucuggcuacuuuacuagagacacaguucaugaauucucugugugggcacugugucuuagccagcauucugggaaggcauuaugaaaucuacagagaaagagccauggucugauucaggaugaaaaggguucaagguaaaauaagguaggcuuggagaaaaguagcaugaccaugucaaaaguucuuguauaaauuacaauuggaauguuaugaaacccuaccucaaaacaagaaaagaagucugagaauacaguucacugucaaagcaccugucuaaaaaggucccgcagagcucagcagccaagaugugacuucacugaggaccagacugcagaauucaaggaggcuuuccagcuguuugaccgaacaggcgauggcaagauccuguacagccagcguggggaugugaugcgggcccugggccagaacccuaccaacgccgaggugcucaagguccuggggaaccccaagagugaugagaugaaugugaaggugcuggacuuugagcacuuccugcccaugcuacagaccguggccaagaacaaggaccagggaaccuacgaggauuauguugaaggccuucguguguuugacaaggaaggaaauggcaccgucaugggugcugaaauccgucauguccuagucacacugggugagaagaugacagaggaagaaguagagaugcuaguggcggggcaugaggacagcaaugguugcaucaacuaugaagagcuugucuggacggugcugaacggcugaggacauucuguaucccgagccuguuccuugcccagugugauuucuguguggccccagaggcuccccugucacagcaccuugcccaucugguuucuuuuggaugauguuugccuucaccaaauaaaauuugcucucuuugcaaaaaaaaaaaaaaaaaaaaaaaaaaaccaaacaccugucuaguacuaaugaggcccuaaauucaaucccaguacuguccuuccuucucacccaaauugaaagauguauuugguucacaacuuuuaacccuaggcuugagaggcagcuguaucucuguaaauuugaggccaggcuggucuacauagugaguuccaggagagccaaggauauauagugagacccugucuuaaaacaaaacauuauguccaacaacaacaacaacaacaacaaaaaacaacgaaacaaugauuacaacaagaaauuguauuuuuacccaaacacuguuguucucccuccuuguccuaucccuguguccuucccauuuucuucagauccagcucauucuuagauaguaaaguuuccugaggccauuacuuugcuguuauauggcugcuaauaaaauaaagcacuggcuuuguguugaacaaugccucagaauaguuggguauggugauguacacuguaauccuaaccauucaggagcaagaggcagauuaggagaaacuuaaagucagucuuggguauauagcaacuucaaugcuagccugagcuauuuuaaaaaacugucaugcaucuuuuuaaaagaaagaaagaaagaaagaaagaaagaaagaaagaaagaaagaaagaaacaaacaaacaaacaaacaaacaaacauacauacauucuauccaggacaggauagaauagggagacucagaagacaaagggaacuaaggaaaauauaagccuaaggaaguucaugaaauuuaauggcugaagaaccuuagaaaguuaaaaguucuacaaacucccucuucaagcacuucuauacaaagcgcacaauuauugggguguggggaagacacuuuucagcagaguugcuuucaaaaguugggcagggaauuccuguccugugguggaacguuuggucacacaacugucugaguaauauaugcuccuauaaguaaccccaauaaauuuacaaauugguuuguucacggaacucaaauugaguggaaucauucuaugauuguaguugauaccauaccuaagguaaaggaauaucagcuaggguuaggguuaggucacuucagguaaagucaugcaacauaccaccucaaaaacacaaaacagaaccaucaaauuuaaaauaaaaggaaaaucuaugagacuaggcauguacaaguuguuuaucucugucugugucucucucauguuaguuauuuugucaguggugcugaggauugcaagaccucuaccucugacccauauccucaauauagcaacuuuuuggaccaauucaacaaaguccaacauguguggaauaaagacaaggaugauggaaaacuucuuagauagccauuuugguuuguauugcuguuaucugcuuuuauuguccuuugcucuaaauaucuaagagcaaaacaauacaacagguuuuuuguuguuguuguuuucuuuuuuaaagauuuauuuaugucauuggucuucagacauacaagaagaggguaucagaucccauuacagaugguugugagcaaccaugggguugcugggaauuuaacucaggaccucuggaagaucgaagucaguguaccuaacuccugagccaugucucuagcucccuugguuuuuuuuuuuuuuuuuuuuuuuuuuugagacagccuaggcuguccuggaauuagcucuguagaccaggcuggccuugaacucucugcuuccccaaaggugacaucaccauuuggcuaaauaauacaauguuuuagcacaauggagacaaauauaacaaaauguuacuauaaaagauaagagucgggcuguagagauggcucagagguuaagagugcacuuccagagauccugaguucaauucccagcaaccacgugguggcucacaaccaucugucacgggaucugaugcccucuucugacgugcccaaagagagugacaguguaaucacauacauaaaauaaauuuaaaaaaagaaaaaaaaaaguaggagucaaggaacuuuauaaucuaccuauaaauuuaaaauuucuaagcaucagcaugccagaguuuuguaagaucuaguacuucugauuaugaaaguucucaacaccaacacuagaacccaugacuaggcaacuguguugcucaaaguaaggucugaggaccaacaacacugggauaauucugacauuuguuugaaacacagaauuuugggcucaccccuacccaacaaucaggaucugccauuuaacuuuaagcuaucauucuucucauuuccuucuuuacuucagauagguguuacucuguagccaggccagccuaauucugccucagcuuccaggguacuggaauuguuacuauguagcuucagagcucauagagaaccaccagccucugccuccucugcugggguuaaaggugagugugccaccauguccucaccagcuaugacuauuuuuaaguuuuccagaucauacaagcuccaaaguuagcaucauagcaaacaagaccaauaauacaaauagcuggaguuagggaacagagaaaaggcccuauuuacauuacagacaccauuagaaaagauacuaauuuccaugugugguaauguuuaaugguagcccugccagagaaucacuacauuaucuggauuauuuaaauaaagaucccauaaaaacggaagcaggauuccguauaguaacacucacauguaagccuaccacuugguaaguggagaggaaaaaaaaaaaaaaaaaaaucaggauuuaauguuaagccuuguuuagaaugaguugaggcaggccugggcuacaugacacccuguuucuuuauaaacaaacaaacaaacaaacaaaugauuauagucaaaucaacagucgaggaaaauuuuuuuuucuuuaacgccuucuuugggguuuuguagcacauaauuugaacccauaaaaaucaauugucugaaaacuuaaaacauuaaauauuaaauaaaaauccuauauaaaagaagucacagaauuauaccagguagaaaaaaaaauaacauauaaaggaaugcaaaucgaaaacaauugugugccaaggaguugagcugacaauacucaaugaaaggaauacaggacuuaaaauccaugaacaucagcaucuacuuaagucuuaaagcaacagcuucuagagaaacaucacauaaaggaaaaagcaaccuaucccugcuuagaaaucucagugcaucucuuugagcaguagauucauuccuucgucuagcuuuucuccagaagugauucccuccucugaaucaauaacuaacccaacagucucuggcuucuuuccuuuacucccuggagggaauacucuccagcugccuugucccuguuagcaguuuuaauccaucuccucccuucuugacuccugcuuuaauccucauugcuuaaaucucuguccucucccaucuuccuuguuuaugaccaccacaccuuucauagauuuuauuaaaccucauuuguggaaugauacuacuaaaaaggggucuacaacauugaauuuuccuuaaccccaaggaaaggagucuuucuuucuuuagcugcuccuugucaugguucuuuucccugagccucugagagcgaucuguuucugagccuaaaggucacuuucuccauacagaugacuaccuauuacuuucucaacucaaagaaaggcagauuguagccuucggcauaucacaaaaaaaggaaaaaauuauuugguuaaauaguucuacccuggggguugcaguauuacuauaaaaugauacauuguuucuuugguaauugggguuuguuuuuguuuuucuuugggggcagugcuugggauagaauccagggccucauaccuaugagaggcucucugccccucucccacucaauaauagucccuucccuaucacaaugguauucucagaacaggaaucuucuaucaucaagguggaaaaaaugaaauuaaaaagagggguuauggggcuggugagaugguucaguggguaagagcaccgacugcucuuccaaagguacugaguucaaaucccagcaaccacaugguggcucacaaccacccauaaugagaucugauacccucuucuggugcauuugaagacagcuacagugaacuuauucuaauaaauaaaucuuuggaaaaaaaaacaaaaaagaaaaaaaagaaaaaaaaaaaagagggguuacaccgggcagugguggcgcaugccuuuaaucccagcacuugggaggcagaggcaggcggauuucugaguuugaggccagccuggucuacaaagugaauucuaggacagccagggcuauauagagaaacccugucuuaaaaaaaacaaaaaacaaaaaaacaaaaccaagaucacccucgcuuacauagaaaggucucaaguacaucccaagcuacauaacaccuguuugaaaauaaaacaaguuuuguuuuugagacaggguuucucuguauaauagcccuaggcgucuuggaacucacucuguagaccaggucugcccugaacucagggaucuaucuaucuaucugccuccagaggcuugugccaccacucgagcucaaauaauuuuuaaggggaaaaaaauuagcaacuaaaccauuaucccaucaacuucuagacagaagagggagggggagcuuccuuuagauugagcaagugagaucguagacaauugggggugaaggguuagaagaaggaaaacugguucaaauaguuuugugaccuuugacagaguggauacaaggaccuaacucuaacugaagacaccugaaaagucaugcuccuaugucguaacuuaauuauauaucccucaggcagucugcuaaaucaauccccuuuagccuucucuuggcuuuucucucagcucucugcuguccaaauaucucccaucuucaaucucauuucaccguguagucuuuaucagguauuuucuguauacuugacuccacaucugcuguuucuaauucuucucuuccaccucuuaguucagcaauuuugguuuuuauuccuuagaauucuauugaacugcugcucugaggcaaacaaugacugcuaauggguaaauccaaaagggacuuuucuguccuuaucugacuagaucucccuguggaauuuaauauucuacccuaggccuucugcccagucuggaucuugacauccaggucuauauacacauacacagccacacccugucccaagaaaagaaaaagaaacaaacaaauaauaguaugaacuaaaaaaaacugaaauaccuauuucaaagucaaagaacucagagccaggaguuagugacaaaugcaguaaaaucucagaaaucuuuaccuuagccuuaaggcagaguauuaggagucuggggguguccuuccugagcuacugagaauucaaggccacucugagcuaaguaagagccaaaucuauaaaacaaaacaaaaacuauacaguaccucagugguucaguauauaacacacauacucaaagcaguaaguucuaacuucagcaucaguaaaggaaaagaagaaaaaugacacagaugaacaguuuuuaaaucugagaacaaaggcuauauaacauauacuucgaaacaggguccugcuuggugguacgcaucuuuaaugccagcaccugggaggcagaggcaagcagaucugagucccaggccuggucuacaaagcccgagggagccagggcucugguacagagaaacauuaaaaagccuagaacgugugcacagagggaacagaaaauagauaugaucaccuuaaacaaaauaaagacuagcagggauauacagcucaguugguagaguguaguugcuuagcaugcacaaggcccugugcucaauucucagcacuauauaaacgggaaugaagucaaguaccuacaauccuagcacuccaaagauggaggcaggacaaucugaagcacacggucaccuucaucuuaacaggaaguuugagggaagcuuagccuacagauccuguccaaaaaagaaguauucacagcaucuauaacaauauauuaaucuuguuauauaaaacaaagaaacacuaauauuuauauguacaguauaaagccaaaagaaaaagcugggcaaaaaccacaaauauacuggggaaaccuggaacaguuugcucaagucaauacuccagagguacaagcaaaggaccagaaguucaaagacaccacagguucuacccgacauccccuuccuugaagaaaacaaaacaaaaacccaaccaccaccaacaacaacaacaacaaaaaccuccaaaacaccaccacuaccaaugguaguaaaaacaaauggcauagcuuaauggcagaaggcaugccugaggcucugggucccauccuguauaccaaaucuaacaaaacccucaaaugggagauaaagaaaaaauauuuggaaccucacuaguaaagaaagaaauagaaguaguguggcagcacuggcuauagcugucuaacaguuacuuuccaauguuugucauguugcagugaaauuaguaacugauaacgugaagaaaggaaagcccgggauaguuaagugccaugauuagcugagugcugcacauguucaaaacugacacaaaauuuccaaguaccuuugacaaagguuccauuaauagguggucauggaaacuccugauaaagacagugcaugcuccuuugcacacuugggaggcagaggcaggugaaucucugaauuagaggcuugucugcucugcagagcaaguuccaggacagccagggauucauagagaaauacugucucuaaaaacaaaacaaaaaacaaaagaguaaagggaucagauuuguuaaccacuaauauuagaaaaauauuguaguguauuuuuuuauuuuaauauuuugugugugugugugugucuugcacucaggagccauaggaaaucagaagagagcaucagauucccugacacaguauuuacagacaguuauguuccaccuaguaggugcuaggaacugaagcuagguccucugcaagagcaguuaaguacucauuuuugguuuuguuuuccucuguaucccuggcuauccuggaacucacucuguagaucaggcuggccucgaacucagauccacuggucaagugaauccccuccccagcgcugggacuuugugugccaccuuguccugucaguucaguauucuugauugcugagcaguagguaguuccccccaaggguaagaauaaacagaauuagucauuaagaaccaaaaccuuggugcuagugagauggcuuugcuuuagucggcagacaugacaaccugaauccaacacucuggauucccuagguagagacaaccaauaccugcaaguuaucugcuaacauacccaugccacuguaaaugugcucaugagugcacaaacacacaaaccaagaauaacaaaacacacaccagaauuccaauucuuguuuuuucuaccaauaagcaaggagaucuacaguauauuaucuucuuugccucaguuucucuuucuguaaaaaaauaaugguaccuacuccacagauuucuuuaaagauaagagaacuacuguauggcggcaggcuucugggaccuuaaaggccaccauccaagaugacaaagagcguuuuaggcauuuaggugaacuguagcacuaacaugccuuuuuuguuuguuuguuuugagacaaguuuucucuguguaacccuggcuguccugaaacuuguuuuguagacccugccucugccucccaaauacuaagaacaaauaugggcaucacuacccucuguuugugcaugccuuaauugccuaaaauucuaauaaaaaaucuuaaaaguccccccugaaaaugucuuuuuggauaaauuccuaaguuucuauaagaauuggugacugauuaaauaccaaaggggagauuaagacuucuuuaaagagccaggcgugguggugcacgccuuuaaucccagcucuugggaggcagaggcaggcggaucucugauuucgauagagaccagcuuggucuacaaagugaguuccaggacagccaaggcuacacagagaagcccugucuugaaaaagagagaaaaaaagaauucuuuaaagaaacaugacugcugcacauuuguggcacacguauauacauauacucagguauacauacuuaucagaauauacauauguuuuaguuuuguaagaaaucaaauugggagguagaguugggagccaaguacuuuugaugucccggguuuggucucuaguauugcaaaaacaaaauaacaaguaaaacagguagggaaauagcuaaguaaaacauuggucacacaugugaggacccagagucuaauucacagaaccuauguaaaaaagcuggccacccagcaaaucaaaccagcaccaucaaauuugcaaucacaugcccagguauuaauuuuugacuacauaaaucuuaguaguguagcauguaagauaauguaguuaaauguauucaauuguuccuaggaaacuaucaaaacaaauacuucauauucaucacugcagcauuuagucauugggagaaaaguuauauuuucaacaaucuguuacugauaagauaaaacuggguuuggcuagauauaguggcauauuccuuuaaucccagcacucaggcgacaagaggcacacgaucaauauacauagagaugcugaggagagcaaaaaccuggguuucaugguacaugccuguaacugcacaugaaaggcagaaagagaggacugcugagaaugcugaggucauccugaucuacauaguguuccagagcagccagggauaugugagugcucgccucacaacaggaaguaaggccugugaggugguggggcgagcacucaggagacaagggcagcaggaucuggagccagggccaucacuggccacaaagcuggaagccaaucuaagcuguaugaaacccuagcucaaaaguccuauauguaccauauauuguaacgucugcuucacagcuuauaugagaaauucauucuuauuauaaauuuacacuguaaacaacaauaacaacaaaaguccuucaugaacugggaauauaaggugcccagugacaaagugccugccuagcauggagagaaugauuaacaagacagucuuaauuauuuguuacagaaaacagauagaauguuaaacaaaaaguugugacuuuguuuguaaaacagacuccaguugacugaccaacuuaugauccugccuuagccucucaaguagcucagauuauaaaccuaugguagcaagccaggcauaauauauacacuaugcaaacaaacaaaagucaauugggaucuagcucagugguagagugcuugccuagcaagugcaaggcccugggauugguccucagcucugaaaaaaauaaaaguagguagccucagcuggggauauccuauauauaucaagccaacuggagcugcccacuuaagacccugucucaagaagacaaaggagcccucaaguaguucaaucaguagagaggacuugguuugauagauacuaaacacuggguuugaaucucagaaccauauaaaccaugcaaagugccuccaaccucagcacucagaagauagaggcagaaagacuggagcucaaggccagccugaggcuacaagaaaccaaggaaagaaaacaggaaaguaauaaaaggagggaacaguagcaccaaguuuuuacuggcuuaaaacaaauuuuuuuuugagccaggcguggcgcacaccuuuagucccagcacucgggaggcagaggcaggcagauuucugaguucgaggcuagccuggucuacaaagugaguuccaggacagccagggcuauacagagaaacccugucucgaaaaaccaaaaaaaaaaaaaaaaaaaaaaaaaaaaaauuuuuuuuaaagcaacaauuaugaaagucuaacaugaaggucacugaacaaaggucaauaugaaccaugagauaucaacauaaggcagaaaacgaggcagauacuuugauuugcaacuuacuacguaaaucaggcuagucuugaaacuuuuaagucuuuccugccucuugccucugagcagcucguguaacucaauuuacuuugcagaucuuuuguuuuguuuuucaagacagcaucucucuguguaucuuuggcuguccuaaaacucacccuguacaccaggcugaccucaaauucagagauccaccugccucugccuaucccagcuuccagguauuuuucuaaaaaagacuuuaagugcucugugucgucaccuuggcuguccuggaacuccaucuguauaccaggcuggucuuuugccucuacaccuggcaauuuuucucuucuuucuuuugcuuuuucuucccuccuuucuuuuuuuuaaagagauauuucauuauggccaagcugcuugugaaucuucuaccucagccuccaaagaguguuaagauuacaagugugugcuaucacacaagcuuaaaauuacauguauuuuuuuuauuuaaaaaaaaaaaaaaaaaaaaaaaaagaacgcuaccuggguuagaauucuaagugugugggcuggugagauggcucaguggguaagagcaccugacugcucuuccaaagguccgaaguucaaaucccagcaaccacaugauggcucacaaccauccauaaugagaucugacucccucuucuggagugucugaagacagcuacaguguauuuacauauaauaaaaauaaauaaauccuaaaaaaaaaaaaaaaggagauagcuuacuguuuuaaaaaaaaaagaauucuaagugugugauaucaugccagcuugcagauaaauagauagauguguuuaaaaaaaaaaaaaaaaaaagggggggggggcuagcacaagccuuuaaucucagcacucaggaggcaggggaaagaaaagaaugaguucaaggcuagccuggccuacaaaucaaguucuugaacaaccaagaccacaaacucuugucuugggagggagccaaucuggucacacagugauuuugaugccagacuagacuauguuagacucugucucaagaaacugcaagagguguuaugagagauggcugagugguuaagagcuuggacugcuuuugcagaggacccaaguuuaauucucagcacucaaagcagugcauacaacauccuuuaacucuagcuccagaggaauccagguccaacaguucugaccuccaaauguacguacacucaugagcacauacuaaccuaaccccccaaucacuuaaucaaaaaagauaccugaugcuuuaaaaacaauuaguagcuccuuagcaaguuaaaagaagucggacaaagguugcaaguaaagcagagagcacaagccuuagaggcaucaaccaauugguaacacugcucauucccaaacaagcuuucuacacaccacuuaguuauuagcuuccucaucugacagcgagacaggcaaaggaaaaaauagcagcuaaauaauaggaugagugcugugaagagaggguaacaugggcuggagagauggcucagccauuaaaggcuaagcucaugaccaaaaacauaagagaaguuaacauacuuccuaugacuguggcagagagggcaacucguguggaugaaaaaggauuucaagagccaagcauaguguuccacgccucccagcacuuggaggcagaucuguuugaggcuggucugguguauaaugagcuccaggacagccagggccacauggugugaccuggucucaaaaccaaaaccaaaaagacugaaaacaaaaaaacaaaacaaaacaaaacaaaaagaacuucaauaaaucacuaaagccauaaucucucucucucacaagugacuuaucuguaguucauacauaugaacauuuugccuauacauauguaugugccccacuugugugccuagaggccagaagugggcaucgcaucagaucuuagaacugcacuuaaccuacauuuguaagcugcuauaugaauguugggaaaaaaaacucccaucuuccacaacuuaacugcugaguguucuucucuucagccccauaauuagaaucuacuccaccccaaacucaucuugguggugguccuagcaccuggauuguaaacaaagcaugugccaguccucugcuaguuccccaguacccugucuuggcuaggguuuuacugcuaaagauacaggcaccaugaccaaggcaacucuuuuuuuucccccaaagauguauucguuuuauuuauaugaauacauuguagcugacuuuagacacaccagaagacaucagauuccauuacagaugguugugagccaucaugugguugcugggaauugaacucagcaccucuagaagaacagucagugcucuuauccacugagccaucucuccagccccaggcaacucuuacaaagacaacauuuaauugaggcugacuuacagauucagagguucagucaaguaucaucaaggcaggaacauggcaguauccaggcagguuuaagaggagcugagaguucaacaucuucaucugaaggcugccagcagaguacucacuuccaggcagcuaggaugagggucuuaaagcccacgcccacagugacacaccuaauccaauaggucuccaacagggccauacucucuaauagugccacuuccugggcugagcauauacagaccaccacaaccacaaaacccaaaagucucaaauguauaauugugaucuggucuuagaggcucuuuauuaaggguagcccauuuauuccacuuacuaaacauuugcacagagaaaaggcuuagaggaagucaacauuagugucccaguauuaauggaaaacugggucccaaguaacuucucuacaacccaacucuagaguaaugcaaccuaacaccuuccuuuccuuacuuuccuaagagugacugccaaaagucaccagagccucucuuaucccucccugagcagcagcucagaaucaucaucccucaacgguccuacaggcuuucaucagucagaauacugaaaaaagcugaaauugugcuaagcuuacauaauugugcuaauaauuacacaagaggaauaaaacacagacacaauuuaggguuuauacagagcuaacagguaaccuauguuugggggcggggacacccaggaccaguguuucuuaaaacguuuuuuuaauacaucagaaucaucuggugaucgcagagacuuugaugcaggagauguggggcagauaaaaccuuauuucauuacgauccccagggcacuagguaugacaacagauccuguuuauaaucuaaacacuugggaagcggacaggugauuucagacuauaaucauauuucauauagaauguauguuccacaguuuuaaagucacuggccuaaaauauaauacuuuaaauauaguuuauauuuuucuaauuugauacccccgucaccccccccccccuuugagacaagacuucacacuagccucaaacucacugauggaauccucuaucucuggaaugcuaggaaugcaaguaugagcuacaauaucuggcuuguuuauuuuuagauaaaaaucggcaaaguugcuuaggugcaguggugcaugaccuuaauuaaucccagcacuuaggagacagaggcaggaggaucucggaguucaaggauuauacagagaucguaucucaaaaagacaaaaauacccugcaaagucaucucagauuuauuauaucucagaguaggucuuuagguuucaccucucuccuuucuuaggagaaaagaacgagauuaguuuugcgauguaucucaguacgucauacacuguacuaccacacaaaaacuacuugauagaaccacuaccauuucuauuuggcugaagguggggaguagggaggaguuccuauaagguuaacauuaagucagaaaccucacagcuuauauucaacaacaauuaccuauaccacauagcaugaugguaagaauaaauagcaacauaaugcucuuaacacagaucaagacuaguuggaacaagcuccaacauucacacugaguauaauaaaguaccauagaauaaaauauggauaauaaaauaauuauuuaccagaaaaaucugaaaagcaaagauacacauauauuccauacuacucauuaaaauuuaaagaacaaagaaauauuagauuuuuaaaacaaguugucaaacaggauacuucuuagaaauacaguguucugcuuaagagcaccaaagggaagugucuuuguacuguaaagaaacuaacaauggacacccacuuagugacccugaaccuaaaagucagucaaugguauauaucuagagaauguaacacauagaaaugaaaacccaaggauccagccagccaaaucaaagaaugcagauacaaaaauaaugucagaacuggaguuacaguuggaugugaggaaucuaauccugguccucuugcaagaacagcaagcacaaagacaucucuccaaguccaugacaucacccuccagcacaaauaagaaacacuaugcuauauccucaacccucaaaauugaguaugaacuguuaaaggagugaguauguggggguugaugagauggcucaggagguaaaaacacaugcaaccaaaucugauggucugcauuuggucuucagaauuuaccugguggagggaacugacuccuccaaguuguccucggaccuccaauaugcacaagagcacaaacauguauguucauguacacaaacacacacacacacaaauugagacagccaggcuugguggacugccuggaauucuagcacaugggaggcugaggcagaauugucucuuauuucagacucaaagucuagguuauacacagccagagcucucucaacaagccagcaagcaacaaaaacaucacuucucucacauguucccacuaugaugcccacaaguaauacuuuccacucuaggcauucauaccucauuuuguugaagaccuuacuuuuuaagacaguaauacaguuugcacucugcuucaaauauagugacuuauuuaaauauaauuuuuguuuuauuuuugacaaggucucacuuaguagucuuggcuggccuagaacuccuggaugcuugucuuaaagucaaccuaacuguauuugaucccuauuuuucaaauuuggguaugaaugccuuuaggguacaaagugauacaauuuuagggcauuugaagccaaacauaaaauugaccauuuuccuggagcuuaaauuaugcugauuuagggugcagugacuuaaauaauuuagucagaaguaacuuuaaaaaauugauauguuugcuagguauagcggcauaugccuuuaguccuagugcugggaggcagaggcaggcagaccucugaguucgaggucagacuggacuacaaagugaguucuaggacaacaaguguuacacacagagaaacccugucuugaacuugaaaaaccaaaacaacaacaaaaggggaaaaaguucuaguaaccacuuaaauagacucaugucaguuuacauaauauuagcaucugaaguuuccaccucuuugguaggugagauggcacaguggguaaaggcacuugccagcaagccugaugaacacagagagagaaugguccccaaacucguccucuauccuccgacauucagcauacccccacugacagacacaacaaacauagcuucuuuuuuuuaaaugaacuuugaauucuaaacuccuuuuuccauuacacaaauguacacaaaauuuuauauuucccccccaaggguuaaaaaaggaugugcuuuuguuugcuuucaugcaaccuccuuucauggagguaaucuuauaucaaauccuacuuaguuauuuagaaaucugagagcagaaaagacccccaauguuaugagaucuuuucuaaauacccuaugauaauccauuuuaauagcaaaaaguacagguuggcaauaauugauaauggcuaucauaauaaaaagcaaacaugggccaguuagacuaacuccaauuaauuaagaaaaauuuuaucccagauacuauauacucgaagauaaaaaauuauaccuauuccauaucaaaauuauaaaacuauaaacugucauucaccauuucacaucaucucccaaaggucaaaacacauaacccaaaguugucuacagaaagacaucauaccugcucugucaacccacuagucuaugguacugacaguuucauauccagaaucucauccuguacuguucuugucugcucugaauuacacaugugcugcaucuucuaugcucaaaacuacccaaaaaauccucuagacccaagacaugucauuacaucauacuccuacccacugcacccccaguacuggagggugaacuuagguuccugaaugcuggcagggauuacaccaugccuauuuucuuacuuuuuaauuuucccaaggguggccuucaacuugugguucucaggcaugcacuauugggcccagcuagucccuuuauaaagagcaaacaauggaauaggcacuuaccucuccguggcugcaaaaucaguuugaggaaggacaaaagaacccagaucuccagucucuagcuucgagucugucugcuagugcaucguguucuuugguucuagauuuguggucauucuaaaagaaaaacagaaaucauuucaugaaaacagcaaauucacauaaauacaccguacagcuuuaaaaaaaaaggagagaaaacuaaagauuacuaugacuggggagaaaaaacaaaaaaacaaacaaaaaaaauccaauagacuaggugguugugauaaugaaggccuacaacaucagcaccuggaagcaaagguaggagauugccaacaguccaaagccaaccugggcuacagaccaagauccuuucucaaaaacaacaaaaccccaccaccacgcaauugcugcuacuauacugacugacugaaucguuuuuaugaaugccugucaugccaucaguacaacagucauguacuuuucagucauucacugaauauauacagauuaaaagaaucugcaauuguuaaaacaguacucuuauaaucauggcauauauacucaaacaccaaaaauuaauuccuauaguugaaguaacaaccuuuuaguuuguuuucuuaucuucaaucaacagugaguaguguuacugauuaaguuaguuuacaucacaacugguaagcuuauuaacaaaugagacaggaagcuuuugcugaccuucgaaaauccccgacacacaacaaucaaucaaauacuuguuucagugaaauaaugaaugcaauauuuuuccucccagaacuaccaauaaacugccaugucucaaguaaugguagaaugaaaucuaucucuacuuaaaaaaagagagagcgagccagaucuagugacucaguaucuuuuaaucccaguucucuagacucuaaagucaaaagcaggaagauuccuccaaacuugaggcuaaccucaucuauacaacaaauaccagaauugcccucgcccgagcuacuuaaaaaagaccgagagagagagagagagagagagagagagagagagagagagaauaugaaucacccaagugaaauacgucuucaaagauggugguguauacucauaguuccagcacuuggggaacagaaguaggauugauuuugaggugagacuaucuaaaaaaaaccaaaacaaaacaacaacaacaaaaagagaaaggggggcuggagggacggcucggcaguaaauaccacuugcugcucuugcagaggacccagguucaguucccaauacccaugugguggcuuacaauuacaauugucuauacuccaguuccagggacucugaccccccccccccaccuucauagguaccauguaugcacgugagauauauaaauacaugcagucaaaaacauuccuacacacaaaaaaauuaaaaauucuuauaaacaacaaagauuuaaaaaaugauauauaagguauaacaaaaauccaucucauaauuuaacuagcucaauuagaccgauauaauaccuuuaaaauucaugauaauggacugaggagauggcucagcaguuaagagcacuagcugcucuucuagaggaccuggguucaauucccagcaccuacaugggcagcucaaaaccgucuauaacuccagcuuuaggggauauaacaccuucaggaagacauacaugcagucaaaacaccaauguauauaaaauaaaaauaaauaaaauuuaaaaauaaauaaaaacaaaaaacaaaaaccccucaaaauauagauauggcaugacucuuuguuaggagguagcuugccauaaacuuauuuuuaauccaagaaacaauuucauauugaaguucauauuaccaaagggaauagaauuuacaucccugaaaaaaauuaaguuauuccagaaaaaagaccaaguguaugaaaaauauacuacucccuaaguauauguuaauaguuuauauacuguuccaucuuuacauuaaaguacugaaccacuaaaacaacaacaacaacaacaaacacugaaaguccguaugguauuuucucccaacaacauagggugauauaagccuguaauuccuuccuguagaagcaggacaaaggcuugaaguuugaggcuaguuuacucuaucuacaucacaguuucuaggccaaccacaacuauaucugcaaccugucucacaacuagcuuuuuuuaucuuuaagaaaaaaauaaauuaaaaaaaaaaaaucaaagagauuuguuuuuauuuuuugaaugagcguuuugccuacauguaccuaaguaaguacauggaggccagaagucaggauagugaauaucccuaaacaggaguuagagaugguugugagccaccaaguaggugauggaacagaaccuggauccucuuaacuacugauccauuccuccauuugcagaggggguuucuuuauguuuuguuuuuaguauugagacaggaaucauauggacgaagauggucucaaacucaugauccuccugccucagcuuccugagugcugcgauuacaggcuuguaccaccaccaugcuuggcuuuagguguuuuugaaaauuaaugggcuaugacaagucuauauaucugagagcagcuaucugcaacauuauacauauuuguuucuauuguucuucugaaaccuggacacucuuuuaaguuauuugaaggaucuauuuuuaucaacaguuugaagccaucucaagccaagacauguaaauacgauauaaagauggccaagucagaguuccuacauuaaagaaaaagagauggugccuguaaagaugacaaugugugauggcugugaugcuagcagcaucccagaaaaaaggcucaaaaggaaacuuucugccaguaaguacaacuguucaagauucuguccuaagacuccucccuaaagcauuagucagccaaguacggagucugccaagaacucccaagccagucauuagucccaguuggguuccuuuaauucuggacauccuuuuuaaaaaucuuaaaacucuuuagaacauaccuuaagguuaacucuuguaccucuuacauuuucuuacaagguuggagagaccccuaagaauuuuucaacuacucuuaaguaagcaggauuuucuuauauaugcagacauuaguguaacugugucacauuauugauuuaaguaaguuaaauccuuaggcuaggcaagaaugcucuguggguaaaaucuauuuccaggaaagccuaauagccugaauugagaauccaaguaaaaccccaggguuuuaaucccaacacucaagagcuagaaguaaacagaucaaguggugugaggccagccugggcuacauaagucaguuccgggacagacagggcuacgguuacagacaaaacaaaaaaaaaaaaaagaagaagaagaaaaagaaaagaaaaugaguauaggggaaggaucuccaagaagucagcugugauaugacccaagacuucacucucagcccuuggaaggcagaucuguucagcaacaaccuagucugcauagcaaguucuagaucaaccagagcuccaaagagaaaggagaaaauggacucuaccguguuguccugacuuucacacacacaaaggccacugaacauggugacucaugucuuuagucaugguuagaagcagguggaucugaguggguaaucuagucuguucuacacagccaguuccuggcuagccagagcuaaauagugggacacuaucucaaaauaaaaacaacaaaaacuuaaaaaccuuuuuuuucuuuuugauuuuugagacaggaucucucuaagcagugcaggcuagucuuaaacucaaagaucagccuaucucugccuuucaagagcugggauuaaagauauguagcacuauacccaacaaaaauaguuuuuaaaaaaguagucccuuuggguuaucuugcauuaauuccccuccuccaauuuauuuuccuuauagacuuaguuguuuccuuuccauuuuuaaaaaucauaagcauacaaaacaacacauuucaugacauuuucaaaggaaucauuguacuuugcuaauauuugcuauuuauuuguuccaguaguauuggggacuaaauuuagccacucaauccugacccacccuaacuuuaaauguaucuggauucaagcuuguaaucccagguauuucggaauuaggaggauugaaagugggaggccuaccuaagcuacacaguaaauucaaggccaaccuaggcaacuuaaagagacuuuaccucaaaacuagaaaggggcuaaagaaauagcucagagagcacuugccuggcuuacccagggcacugaguucaaaccccagugcuacaaaaacaaaucccaaccacucaaucugcuaaggcagucucaugcagcaaaggguugccuuauauuugcuacaaagccaaggauaaccuugaacuccuaugcuccugccucuacuucugaagcacugucauucacuaccauugggaacuugugcagcuucuuuucauaaacaaaauauggcacuugucaaacacaaacuugacaguaaaacucuaagaauauaauaaauuacauaguuuggcuuaauacauuuuaaaaacaaaguucuacaaggcuggcacucuacacuacuacuaaagagagaaggugaggaaggacauucuggagaauuaaaaaaggaaugaggugcugcugaaaugacuaagaacacagugcacaggccgaacacuugcauagcaugcccaagcaucacgaaagcaguuucauaggauuucaauguguggcuaguguggccuaaccagccagagaauccuggguucauuuauggagggcagaaagguuggggaguguucaaagaguugcauacaauguggguugcuaaaaccuccaaacugaaaucacacacaguaaacaacacaaucuuucuuagcaucaagaugauggaagcgagugcgucguuggagcacaucuuuaaccacagggcuaggaagacagagagagaagcaggugaaucugaguuugaggccagccuggucugcagagcuccaaggacagccagagcuagagagacaguguguuuguguguguguguugguguguuaaagcaccucauuaucuuuucuuucugaaaaugucaaccuagauuuuuuucuuaagaaccuaagccacacaucaguggcuaauugguaagaaaauccguguuaagcgugguggggaaaggcuuuuaucccagcacucgggaggcagaggcaggcggauucugaguucgaggccagccuggucuacaaagugagcuccaaggcagccagggcuauacagagaaacccugucucgaaaaaccaaaaaaaaaaaaagaaaauccguguuagaguggguacgaaaagguuacuccagcaguuuaucaaaggaagcuuuuaaaugcaaaagacuuaaugccaggauaaauacccuguuuaauuucuuuuccugccuauggaugccuuggaauuuuagcuuucuuaguugaucuaaacuccaaaaaaguauuaagucucuuugcuaauguuuacuuaaugcuaaacucaauacaggaagucagauacuaaagaguaguuacauuaggcacagaaauuuauaaaccaucugcugcaagugacccaggauccaauuacaacaucaacccucacauuucauccaacagucaaauuaccaguccagucaugaauaaguucauucuacccuauuggcgcauuagaucgguuugcacgaucucuagagaggggcugaacugucuuagccuagcccuagagcaucagguccuaaguggagugcaaaguuagcgucaggacauuuuaaauaggaggcaaacuccagcgucgccuguaccaucgcaaccagcccaugcucccgaauuuaugaguuuaucacaucacuugagaugagagugaaauuaaguuucagucccuuuugagauuucugagcgcaccaagucugacugcuaucguuucaaggggcugaaagagugcgaauacagcuggagaaaaacuacuuuggugcaggaauucgugucuuuuuccgcgcaccauugggggccgcaccggucgggucccgcgcgaugcccuggcgugaguuugggggcgcagcggggcccggcgggggcggcgagcgcgcguucccccgcccgcucgggcggcgucgaggcgcgagcagcucagccagccuugcagagggagcucucggcagcucagggguccccucugcucgcagccacagcagcgccgccugcgacacucggcggcgacggagaccggcagcggggacgaucggacuacgagagacuagagagcaccccagcugcuggagaagcaacgcagggagaucggguagguuccgggaccggcuggacuugaagauggggagucugaggcgcgucggucgggacccgacacccacacgguuccgggaccuggcuaagcggccggccgaggguucagaaccccuaggcgaagcaagcggcggcaaccgagccucagaggguccagacucgguaagggguauccgucgcgggaggggcagagggcgggccguggcccgaagaucagccgggccaaaagccggccucgaggguagagacaaaggaaggaaaauggagucgccgagcgcgcaggccucugucgccaccgccgccagaggccuaccauguugggaggagggaagcuuagcgggcgggcgggcgggcguggaggggguuggccaggcccuggcggcggcgccgggcaauggcggcggccgcgccgcagcagggacgguagagggagacaaacaccccccggcggcggcgcuggcgcuggcgccgggcugcagccagcgccgaccggagcggccccaucgugacaccuagaggcggcccgcgaaaccuccuccaccccgggcccccuuuaccuucgcgccacaccccccgcggcgcccgcuccgccgccgcuccaccgcuccggccaccuggcguccccggccggcuccgcgcgcccgcaccggcugcugcuggucgccgcugccgccaaagaagcagcuccgcgcacgguuuaaucgcuccacaggcucggacacaaaauggcggcggcgcggu

SEQ ID NO: 12424 - RNA, 66880 nt, Mus musculus
cacuggugugggagccgcggcgcacuacugaguucccaagaacuucugcuagacuccugcccggccuaacccggcccugcccgaccgcacccgagcucaguguuugcucggcgucugccggguccgccaugggagcccggugccgcagcuuuuccgcgcuccugcuccugcugcagguauguggaggguccugacucgugccccaugauccgcuucgcuguguuuuucugccggcuguggucccgcuucccuucuuccaagaaaguugggauccggagggccagaucgcccugggcgcugcgcggugcggggcugagugcgguggagugggagggagguccaggcgggcgcggaguggucgccucuggcgcagguucccaggugggggcgcgccacgcugccggcucccggguccccggguugagcagggucccuguuugagacagaggaggcguggagcaggaugggggccugccuguagaagguggggugcugaaguagcgcggacgauccgagauaagggaagggauuuuaguauuauaaaagcaccuguccuguuagggagggaccguagauugggguacccgagaggagucugcgggugugcguugagaccguucgcggucgaaggaaagugguguccggaagagucaaggcgucuccagugagaugcaaauggagcuaggagaggaagguggacuagguugccaggugguggccccagauguccccucccccaaaggcuuuuggagcuuggcggcugguuucgggaugagcggauagcgucccugugugcccugagggggguccuccccacuaaucccggcgcccgaggcgagggaaggguuacccuugguuucggugugggcugcugggaacccccucaagucaccaguuugcuuacuuuaccuccaucccaggucuccucauggcuuugccaggagcuggagccugaguccugcagucccggcuucaguuccgaggucuacaccuucccggugccggagaggcaccuggagagaggccauguccugggcagagguaagggaaacugaugguguuacucggccgaguggggucggguagugaaggcgccaagaaaucgugcuaccaugcugguaggguggaauggacaaaacucuuccuuggaauuuacggcagauuugggagucuuauuuaucgauugugguugaucaagguagauaugucuggcucugcuauuuauacggggcagaaaugggccaaggguauuuagaggucaucgguauuccuccaacugauuacuggagccggucuaucauuucagaccgccaaaccugcuggguagagccaguuggacuguaguuccauuuaaugaugagcaauuggaggcucauagagugacuucacagggucagcagggcaggcauuugaaccgggauuugacucccacuauuuagguauagucacugaggaaccgguucauaaugacuugugguuuuuguucauaaggauaaaaauacucgauacaggugcugcuuucccaaggaauagguuuuuuuuguuuuguuuuuuuguuuuuuuguuuuuuguuuucuuuaagaaaaaaaaagaaaagguagcucugacucauacauucaaacacucaauauauauugaggucuuauugugauaaucuagaauuuucuuuguauaacuguagggaauggcugggagcaaggcaagaggaccagguuuuuguuaauguuguuucuuuuuuaacuauuuucccuaguuucuaggugcuucuuuugcaccaaaaugaccuccccccucaugauuuuaguugauccccaaaguaugauaaacaaaaagcaauaauuuuaaaaggagaagucacacacaaucccuuucugggaauagauucaccgagguucuucuuccagucguaagccaccugaaaaaucuacagcacucaugauggugucuaaaaguuugcugugagcuuuggaaguuggguccagguuugguggugcaccuuacagagaaauagcggcccgacugguuggucuuaacuugcuuuucugagaucugacugguuuuguggagcuuucuuuggguccagaaaggcugcagcccugugguccugagguuggaauggucagggauccuucagccagucuccacgugacucuugcccaaggacgaaucugagccucugguagguugcugagagcagggagcauccggccugccuucaguggcacguugggaugggcuagcgaggcaugaguguucuaggauguuuccaaggaccgcagugagugucugagaauaaauaaguagacgucgugucacucaggguugagcuuggugggcuuggagacaggaaugcuuauauauuagggaucagugcaaguccugguggcuugcugaugcguaugugugccugaguuacgacagucuuugguagcagugcuaaggaugaaaccuucagccuguuguuacauguuagccaggcaccuaaccaccaguguguugguugggucgauuuguuuguuuaugagacaggaugucccugugugacaugggcuggucagaaauucacaguuugauuuuccugcuucagacuccagugcugggauuccagggucaccuugacgcugacccagcuuuaauuuacaccucuacgugcuagugucuggucacucacaccacugcauaucagugacaagaucacuuaaaaacugauaguaccaccugcucacucacgccccuuaaggcgagugagucauuuaccuaagguaaaaaugagaacuucuggaggguggacaccauuccaguccucaaggaaaucaggagccugaagcaucuacgacugguccuccucuuuuugguuuucuuuucucucaaaaagagaggggaugaaaacaaaacaaaagagagggaagugagugagcugccccagcgguggucacaccugugaccugcacucccggaagugaagugugugagcugcagcuguggugguucccauucgugaucagcccuugggaggccaaggcaagaggauugcuaaaaguuguagguuugaggucagccuggucuaaguaguggguuacagacuaaccugggcuacagagugaaaugagaccuuuaaaaaaaaaaacaaggaaaaaggaaggaaggaggaaggaaagaaagagagaaggguggaaaggaaggaagggagggagggagggagggauaugugugugcuuuuggggaaaacaguccauugugaaauagacuguggacagaggucuuaacguagggggagcugagaguggcugguguugauggagauagaacaugcuccgcgggagguagagagcccccgcugagagcauugcccccgcccccaaaggcagggagccacuucaccccgcugagagcacacccagugggagguagagagccccgcccccgccggugguuuaggugggagaagcacccuccacacagcaucccacaagcuuccaugcuucccgcggcugguuccaguucccuuuaagucugagacuccaccacugcucacccggggucuaauugcaccaguggagugugggauugcgcuagaucagagguaucuuuccagaaaucacacacugcaccccagaaaauugaaaaugaauugccuucauuuaggaagguggggacacucuuucgaccuucuggggaaaccgaggauugugaccuuggcuccagguuccacuaugcaggcuucugagaaucugacacagguggcuuaaaggucacaaacaggcuuugaugagcucuguuagcaucgucccgaugcccuguaagcuugccuguagaaucucuggcuucuaaaaugcagaaucuuaaaaacugaaaacccaaaccccuccacuacccaagcauauccuuuaguuagguugauuuguuuauuuuuucuguuuuggguuuuuguuguuuguuuuugagauaggaucucacuauuagccuuagcugggcuggacuucacuguuguagaccaggcugcccuugauuucacagagaucuuucugcuucugcuuccugagugcugggcagacacaccagcuguggcucuucgguuucuauuucuuguuuuuguuuuuuugagacagggucccagguaguucaggcuggccugcaacccucuauguaguagaggaugauugaauuugugaucuuucugcucccacuuuccuggggcuaggauacaaguguauaccacuaugcugguucuugcuuguuuuaaagcugauucacuguuuuuguuuguuuguuuguuuuuacuuuuauuuaauauguauguuugugugucauucuuuucagggacuaaucucugucccguucuaauuuuaguuuauguguggcagagugaagcacucugugguuugagacagggucuaacccaggcuaguguggaacucaacaguguagcgcagauuagccuugaauucauggugauccuccugccucagcuuccugagugcugggauucccaacaacaaucaccaaguccaguuuaaguuguuucuuuagaguuguugauuauuauuauuuuuuuaagcacaaucuuuucagggaucuggccuuugccuuucagagcuacaggauuaauacacaaaguuacauccauguagggugcugguaaauccuuuaauugauggcuuccacagcuuuuuuuuuuuuuuuuuuuuuuuuuuuuuuuuuuugguuuuuuuuuuuuuuuuucgagacaggguuucucuguauagcccuggcuguccuggaacucacucuguagaccaggcuggccucgaacucagaaauccgccugccucugccuccccgaguacugggauuaaaggcgugcgccaccacgcccggcuuccacagcuuuauaaugucuguaggacaaacgggccugggcuuugguuauuugauggauugaccuaguucucaggcagccaccuguguggacuaaauacacccauuucuucuccauucugaaggaugugcugaaagccgccuuggacagugagaaaagcaaacauggaagccugcuguaggaucaccuuacaccaucagauacccacuucccacccccggcuuccugaacuuucuguaauuacucaugccagugacuagggcucaugugggccaucccaggaaggagacuaguggcugccauucuguccuggucuuugugucucccgaggaggaguguagguggugaggucacaggcuaagccaggccauuuaaggaaagcugccucagcuccagcccagcccucucugccagguggauauggaaaucccgguuuacucucuggggccuuuuauuggcugaaaugcucaccuugguaucuguuacacauucccuuccaagagcagagcuagauaagccagguguggagacaaucagcucuugaaaucucccagaagcugccaaaccccuaaaaucagcaagagacaccccucauaguccagacucagcuguuuuauucugccucucccugaucucuuuucagggcauaaaguuuuccaaggagaagaaugaaaucaguauagcaggucauugagaaaguauagaaaggcucagguugaacuucagugucugcuaccaaugugucauaaauaagucauuuuacuacugugagacucaguuuacccauuuguugaguaugaaaaaaaaucauauauauuuguuaugcuauauguaucaaugcauauuugauucauaaacaccucaugcuaacuggaguaugugcaucuggcuguccauauugaguuacuguuuuaagccagcccuaggcuagacucuggggcuaaagcaaugaguaaaacguauuuggcugaacauaaauaugggagggggguggaaugcaugaauguaaagaaugcuggcauaaguaggaccagugaguuggguguggcagugcaccuuggagacagagccaggcggaccucugaguucaaggacagucaucagggcuccacagagaaauccuguccaaaaaaaaaaaaaaaaaucaguggggaaaggcaccugccaucgaggcugaagaccugaauuugguccacaggauccacgugguaggaaagaaagaacuuccaaggguuauucucuaaccuccauacuuauaugugaguguacacuuaaguaauguuuguuuguuuguuuuguuccuguuauguuuuguuuguuuuuaaagccaagucuggugguucaggcauuuaaucauagcacccagaaggcagaguucaagggcagccuggucuacauaggaaauuguaggccuauacagugaaacccuguuucaaaggaagauuaaaggaaaaaagucuugcacucuuccacacccugaccaaaguccuauagugaaacucugguccccucccucaucacugcuauugccaaacucagucucccucuaugacccacaucaugauagccagggcuagaccguuuguaaagauaaaucagccuugucuggauaaauaacuccaggaaggagaaacugccggcuguaaagaaccuuagcagucguauuccccaaaaccaccuauauaagccucaagugccccuccaccuuucacagacaccccuccccuacgggagaguaucuguccugcacuguuugaaauaaacaguccugucuguugaggucagucuucagucuuuuuuucugcuuccagucucuuaaguugcuucagaaauuuaccaagaaucacuaaauaaagccagcugugaugguccacaucuguauuccagugcuucgaaggcugaggcagagggucucaagugugaggcuagccugggcugccuguggaacccugccuuuuuuuggggagcaggcuuuuaaaaaauauuuaucacggugaaauauaaggcaggaggauuguuagaaguucaauaaggacaaucugauucuguagugggguucaggcuagcuagggcuacauacuaaacaaggucucaaccuuguuuuaguaagaggaggaggaggaaacagaaggaaaaaaaaguaauuucuuaggcacccaguaggccugcaagucuuguuuugaacaaaugaauggaugcaugaaucaaucuuugcuaccuuucaggcucuauucuguguccccagagcacccccggcccaggaaagugagcagggcacgguaggucugcuggaaucucugauuguacuugugagggcucugccuagcagucucccuggaagcugagccuggccuuagccucuuccuucucucucagagcuucugaagccacagaagggacgcaucaaacucggaccuagaaaugaacgauuagucuuuuuuagugauuuuuuuucuuccgucuuuauuuuuugacacucacuggguagccuuggcuggcccagagcucccuagguuggucagagaucugccugccuccugccuggguguugauauacagggauucaccacucuaugcucuuacgagcuggcuucgaacucaucaggcuuagaaugucgggucgucucacuuauaccuccuaaguguuggaauaaccagugugcaccacccaagagccccuagcugggacucuugccaggccugucuucucuaagccuuaguauccccaucuccaaaauggguauaaccauaugcauacguauccuaagggcauauaccaaaaguucagugaauacaguagaguauguaggacccccugcgggcuagcaguagaagccuuucccuuuccauuauacccuugguucuaaaguugguugaaaguuccccuaagcucucucccgcccagcaaaccagucaaaccaguuuccucauuccccgggcuucuguacuaagcaaacacugcuuugcaaacgguugaccaggagcuugccuuuguuagagaaggaaguccaaugguguuuucuuccuugcaaugccgggaguggguuugcugugccuuagaaaggguucaaacugggcuggaaguagggccccagaguagcuggggguuggggauucaggauggccucaaguuuguuguuccccaaacccucacuuuuucuagaacuauuucauaauacacaugcuuaaggauacccauuuguugacccauugcaaaaugcucucugacccagcuucugagacugguucaccccccauggauaagaauugagucaucuggugccauucacaaauacagauuaaccucccucccccaauuuacugaaccucaaccaaaaaaagauccgccugccucugccucccaagugcuaggauuuuaaagggccacgguaccacacggauggacacaacauucauuuuccugacagaccaggagucaggucacagguguuugacuaguaaacacccggugccaaccagggugugggcauuuggcuaucuacccugaggcccaagauccaagagcacccgugguccauggugcuaggggacccggaaauguagccagugcaucagagauccagccucuguccucagggaaguucagaaacaucucugcuuacugagacuucugcaggguauuugggaagaggggccagcacagcaggcaugaucaguuuuacaugcugggccuuuguaaguaagaggauguguccaggcacaguaaaggaaagucucccccaggaccuugggccuuuuuauccacuggugaggcuuuuuuucucuuucuguuccccccuccccaccucccgggcuuuccagacagaguuucccuguguauucauuccuggcuguccuggaacuugcuagguagaccgggcuggccucgaacucaguaugaacaaauguuuacuuauggcuggcacugagacuuccucuucacccugacuccucacccagagcuuccccugaacagaauucucuugguuagccuucucaagaucuucuguggaaaaggcagagauagucaugggguguggcucuguggucaggcuaaaccuaaugagugugaggcccugacuuugauuccuagcauugaggaaaagcagaaacaggaaucuuacccaauuuuccucugccuguuaccagacucaaggcugucccguggagcccauugcccuuccugagaaacccacuuccuuuccugaggcuaggaaagacaucccucaucucugugccucaaucucauugauuuuugugguguuaaaauucaguuauuugucuuugagagggcuccccuccccccuuugccuuucacauccuuucccuucuuuauugcuaugcagaggacccuaacuccuaggcaggcccucuacccuugagauacagcuccauccucuugcuuuuuaaaaacuuaauuaauucgagacagggucucacugcuacccaggcugguuuugagcuuacucugcagccuccugcaucagcccaccgccuuguacgugagauggugggccugagacucagccucuugaccuucacauacaucugauacgugcuaucugaacaggccugucuuacucaguuuucuggguccuguuggggggugagguggggaggggagaucuucguucaggcauggagaggugggaaggaaaccaguccacaccucuaacaagugaguuccaacuaggacuugcuuagggcacauaaggcagacagacgugggagaugugagcggcggggaagcgaugaugcuuagaugcuaccacgaggaccugauguggugugccugaagaugaaccuguuccccaugagccagcucauaaauggggaccagcaccggccccugugggauaauuggccucguccuagauaauaauuacuuagcuuuguaauuaggagagcuuguaagaagccgaaaguguuucggauuuauuuuaccuggacaaguucaagacuaaacuaacaccuguuccugugguuuggcaugcagagccaucuguuuccaaaggagguccugcagcagcuuuuuuugggguucuccucccuguuccuucccuucucuccccacaucgccuuuucuccguccaguggucaguguguguguguguguguguguguguguguguguuaaugagacagggucucauuauguagccuugggccuggaacucacuauguagauguggcuggcuucaaacucagagaggcauaucuauccacuugccuuugccucugccucucaagugcugagacuaaagggaugugcuacuacuccuggccagagugauaaguacucauccuguuuaaaguugccugggauucccuguuugacacugaauaaaaauccugcccaugacuuccaaggcucugggucccuccuucccccgcagcccauggcuugggccuucauuuuaaccccacuccccacaugugcuucguucagaugcuuugcuuccugauuguacucagaauaccauggcagcucgggcugaggcugguuuugaacucuuaauacuccuguccgggaguaguagcaucucagguguguccaaucacacucuauguauuccuuguuugugaugucuguaucacucacccgugcccuucaaagcuuugcuaagauguugccugggcaaugaggaccuucucuuuuugcuuuauuuuucuguagccccccaccuccccguuuuuugggugguuuugguagggaugagacauuaagauguugccugggcaaugaggaccuucucuuuuugcuuuauuuuucuguagccccccaccuccccguuuuuugggugguuuugguagggaugagacaacagggccuuaugcagguuaugcaaguacccuauugcugauccacaucccagccuuucugguauuuuccaccauugaaccugucaugugguuuguguauuuccucaguucauagucuucuuccauaaaaacauaaauguggccggacgugguggcgcaugccuuuaaucccagcacucgggaggcagaggcagguggauuucugaguucgaggccagccuggucuacaaagugaguuccaggacagccagggcuauagagaaacccugucucaaaaccaaaaaaaaaaaaaaaaaaaaaaaaaaaccaaaaccauaaaugugaggaggucaggguguucuguguuuguugguucuugagcuguacuucaggccguaacaaguucuuagaccucaucuguugaaugagugaacggaggagugagagguccagaagguaaauauggcgcuguacaguucuuuuuagaagcugugcuguggguuuuguuuuuucuaagauaaaaugggguccagugacauggcucagaguaaauguaaauguuguaccuuuuggcauccuggguuuuauuuuuccagaacccauuuauccugugacuuccagaugcgcaccauacccccuguaaacccccccccccccaacacacacacacaccaaacuagcaaacagauacagggcugucagcgugugagcacaugaggaagggaugcuauguucucaggcccuguguuucuucuuggcacccccugguuucucugagcccugcacagcuacaguguaaccuuaccuaauugucuuguuacaaagaaguuugcugcccagagucuaaaggucagaugagucacuugggccucacacuucuggguguauggaagcaccagauggaagucucaagguacacccgacaccggcugccuuuccgucgucaggcagcacauuccugaagcaggcucucucagcugugcccucucaaccuucauccugcagcccauuaauuguucaaggccuucuaguucuuggcaggucugagcaucuuggaaggagcuagaagagagauguagaaagcucaaagacaaaaaugcaaagcuacccccaucagauaccagcucuugggucuauugaccagccaauauccauugauaguggaguucuacauccauauggaagauacaccauucucuuucauggacaggagugccaaaucagaauacaggacauuacaucuuuuugagacaaggucuuaccauguagccuuuguagaccagcuauguagaccaugcugcccuggaacccacagagauuugcuagcuucugccucccaagugcuaagauuagugacacacaccuccacuuacacaguacacacccaggaaaaaaguaaaacauaaauaaaaagcaaaaaauuguugugaaauagcucaguauuagaguccuugucuaagauauaugggcuccaggcuugcccauccaucuauuuucugagacuggauuuuucuguguagcccuggcuguccugggucuuacuuuguagaccaggcugaccuugaacucagagauccaccugccucugccucuggagcucugggguuaaagguagaccccaccagccaugggcuuaagcccaguauggguuuaaaaacauggaaccgauuggacuuugcauaaaguuagauuggauccugugggugcugaccucccaugcuuucaagcacuuauugguagcauucacugaacaagccugagggcgggaacagcccuggcaucuuucaaaggguauccgguucaaaccagaaucgaaugcucuuuuccuagccaccccaccucuuggcuuguugccuaaggaaaauggcucuagccugguucuccaguguucucauggcagucuggagagauuguccauuuguaucacaaccuuuugggcgcugcccuuggugacccgcugcugauguggacaccagcaagacuugagacugcagaccuccucccccacagauuucucacaaugcccgugugggaguguuugaaaagggaacaagcugaccaaccuguuugugggaaagucguggcuuuccuaucagaaaacgucacacucugagucaggagugggacauaccuggguacuuuaacagguggggcaggguccugagucauagagaggucucaccugggaagguuucucuuucaaagagugaaucaaccaugacaucacccaucuggaucuacacccuuucaagccgucucucuccuuagcaaacaggaaucuaaaagaggaauaauaaggugaaagcaaacuggaaauaggacagaacagacaagggaaaaaguuaaagagaaagcuuaagagacgcagacacagacguuuacaugcaaacaggggguccauaaaaacaaaaccggaagccguaauauauguacauggccuguaagauuagaaacaaauguccuggcacaacauuaugggacaacuucccaagcugcuguugaguuuguuuuguguuggccggcaugggcccuuaaacugagugguguguuucucucuuagagaauuuuucaugaacuaguuuuucauuugcaagugguuaguaguuugagauagcuucuagguuagggguggggccguguguccacuuuacucagcucuaaugucccccguuuggugcagaccccugcagacccuaugcguccugccacagucucugaguucaugccugcauuguucaaauuguguuuccuugauguccuccaaucuccucuuugcugggcucccuggggcccccaaggugagggauuuggcagagguauucauuccauuuaggguugauuguuccaaggucccucacuguacguguuauuugucccuucucccuggcuuccugcucaggaguucugcagacauggcugguguuuaguagcuucuuggugaaguucagguagccaguuucaugaccacccagcucucaggccugacuaagcccguggagaaagcccauaaaauaaagggggugaacuucuaaucuacaucugaaaggagaaccccugucuacaucuaccuguuacccuagccaucggggagacugaggcagaaggaucuagccuggaaauuuagggugagucugggcagcauuaggagacuauuucacagugaagaaggaaggaacucacucacacccuuggugcaccucacaggucucugggcucagauuggagucuuugguuuugaaauuuccucaucaucggccgccucagcugguuuuucuucuggagucuguuacgccuucuccccuuuccccccuucucuugcuaauccuuucgcuugaacaauaggaguccuuaaaaccugggagggaaguaaauaccuuucagaugagacccugucuuaagagggggaaaaaaaaaacaaaaaaacccuagggaccgggucaccaagugucagguuaaucagcagaugucaagaugacuccugagugcuugcucuuucuucagcuggugaaauuacagcggcaacauagaaugacagucagcagggagggaggagagggccuggguggccuggacagcggccccuccuugccauuggaccucaguaaauugcuuaaccucaguccgucugucccuuuaccugugaaaggagauagggagccagugagcuaacauucauucacuucugcuuucagugccuggugcuuaagcauauggagggguuuguuuuugguuuuuguuguuguguuguugcuguuuuugagagagggucucuauagcucaggcaggccuuagaaugaugauguaauccagauuggccuccaacuugagaugauccucguguccccaacagcacuggcuuuacaggggccgucugcuuugucuguagauauggugauaggagucugauuuagaaacuuccuuguucuccucuucccgaauccuuccuccugaacaauaggaauaccuaagugcacaagugcaggugcccaggaggcccugagacaacccccccuccccagcugcgagccuucuccgguggugcugggaaucgaacuggaguccucugcaagaacaguaugugcucuuaaccacugcaccaucucuucagcccccucuaguucuuuaguuuguacauaaauuagcaaguucagggaaugcagaagaacuggccaggggucagagccagacuggaaacauuuuucaccaaacaauagcuacaguguucauggcgugccuccauugaauacuaaacuagcuguugaugugugacuuugauuuuuaaucuuugcaccaacuuuaguuacuauauagauaauuccauuuccaaaugauauauaguggaagcuuguaaaagcugcuuacuaucccaggguccccagccgagaucuacaugauaaagcuacucucaacccagccuacauucccccucccugugcucagcccuaccugggguuguucacuuucaagcucccaggaaggaaccugagcgcucccugcccccaugcaguccauuucuaucucugguccuuuggguacuuggagccucaagcuccugacugcuaaugaagccuguaacagaagggcauuacuuacugcccgccuugugcucccuugaaaucuggucaccuggagguggaagugggcagugcuuccgugcuuccgugcuuccgcuuucucccagcuccuuuuaaucacuauuuuuuuuuuuucuuuuccaaauuacuaccuaggaguuuucuaguaaucacuuuggugggagugggagggggaguggaggcaguuaacucugugagugccaaggacaguuguuggacggugguagugauggaggggaggguguucacggugagggaacucuguggaguuacguagcuggcaacaauggggagagacggagccgcaccaccacagacgcuuugcaugagcaacuauuuuguuuucuguagauguuuuccaaaccuuaaacucuguuaagucugaaacugggaggggaaccucuccaccaaaaucuaaauauggaucagagauaaggaaacuuccauagucuccagcucccucccugacucaguggccucugugaccaacuccacgugacucuaguggacaccuuccuggugguuuggcuuuuuuuuuuuuuccccauuucaucuuuuaaauggaguuuuccaugaauaagaauauaaaacugcgggggcuggugagauggaucagcagguaagagcacagagguccugaguucaaaucccagcaaccacuugguggcucaccaucgguaacgagaucugacucccucuucuagagugucugaagauagcuacaguguacuuacauauaauaaauaaacaaaucuuaaaaaaaagaauauaaaacugcuuccuucccaacaggccuuggauaguuuugucugugggaacagcuucccauaggaaaggugcuuuugcuacuuccgaccgucacacacuccuccucugcaccccgugagggccucccaggaguuuuguguuggucacaagccuccccaugucccaagggggucuggagagggaucugaggugguggaaagugcuggggugccaaguuaucagacaaugggcacauugagaaugcagguggggccaggccugugugggcuggagcagcugucggagccucagggggugcagcucaugcgcagagggaagaggcagucucucugcuggcugagaggggagggccacaguaagcaaaggaggggggugaucccccccucacaagauuccagagcaaagggauguuugaacgaugacucacaugacaggggcggggucugugagcaaacuuccuguuggaagcuuguucuugguuccugacuguccuucccaggucauagagacugucugcaauagggcuggggccuguuaggaugccaucgaggugggaaauccuggagagcuuggaguagccagcaggcccucuucccucuccugccccaggcuagcuggaaacccgcgaggaggaaggguguguuguucccuaucccauggagaggcuugcauggucagaccaggccuggugugaccucuggggcugcucugugacugcccuguucugugacugcccuucucccucccagcccuccccuuccauuugcuucuagauucgucuaggagcccaucucagcaaauggcagcauccucgcuuaccagacaucuuguuuguuuguuuguuuguucauucauucugggccugaagauggagagcugugguaggggagagcucagaggcugggggcagccuuaagggcacagccaggacggagccucugagcaaagggcaguguguguagagucagguagguggugggcagcaggagacaggaggagcacagagguagguggcacuguacagaggcccuggcaccauuuugugacaaggacucucagaccccucuagccuauucccccacccccacccccauuacaagcaguagggucuuaauagcuaauggcuuggacaccagccucuggcugcucugguucccagcuggucagagcccuuguucuccuuuggguucugauccagguggcacagggugggggcccugauucacauucuugauagugccgcuagguucccugcuaccagcuggcacauucugucuuccuuuccagcagguacuuggcugggcuuccugcccagcugcuagaccuacuguuaggucagcucauuggaugcuuccuccaggaagccuucucuaaucuccauucccuuggcuucuuuucaagagcagaaguucacuggcuucuccuguuuccccagaguagcaccuggugucucaaguacucgcuaagcaguuaggagaggugugaacugggccucagggaccccagagacaggaggggaggucauuacaggaaagucggauucuuuuccuggcuuuguucuuauaaccaucguguguguguguguguguguguguguguguguguguguguguguguguguguacguguguguacguguguguguguguacaugcgugcgcgcacacgugcacgcggcugaugcccucuuucuggccacccuuuauuuauuuguaauauuuauuuauuuauuuauuuauuuauuuuugguuuuuuugagacaggguuucucguauagcccuggcuauccugaaacccacuuuauagaccaggcuggccuugaacucagaaaucugccugccucugccucccgagugcugggauuaaaggugugcgccaccacugcccggcuucuguucacucuuaagcguacccaacagcccauccugcaccagcccagagagucugcagaguccccugugaaaaugugggcaaccuguuccuccuggcaucagguggggaggagaggcagauuaugcagaaucaaucaauagcaaucaauagguccaaugcggaggagacaaaggauugagaugagacagggggcgucccacguccaauuccuuuauugcugcaguccuuucugccccucuuuacaaacaggagacugagguuuagaaaggcaggcuaggguaguggguggaagggugaggugaaccuacaggggagacuaaggagccagaugaauggggaaagggaggcagccucuuaauccuuuugucuguagcuccaucuuuggaaaugcugaguaauuaaucaauuguuaaagggcuuucugccgaauucuggggaaagccuuuacuuuuaaugagcugcuagucugucucuucagugcugggaaugagucuagagccaccugucuccuaggcaaacacuuuacugcuaaacuacuaagcucugcucccccacacuccggguuagccuuuacaucuguaucugucugccucuguugggauuucaggugugugccacccccugugcuccucaguguauuucuacaggguggugguaccuaaggaaaaauccauuccuagggacucugacguaaauauuugggaugaggucugucaaggacugggcauuuuaacuucacuuauuuuuauagcccugaggguggacaugggaccucuuguaggcuagguagguuuccuuccuuuuuucuccccuuuuguuucuuuuucuuuugacagggucuuuacuagccuugggcggucuggaacucacuguguagacuaggauagccucaaacuccuaacggucugccugccucuaccucuuggccuagggcuguggacugucuuuuugguccuacuauaaggaucaucuggaccagaacgcacguucucaagccuacgcuggggagugccucaccuagaaagcuuaaaagcguagacucucgcuggaugugguggcucaggccuuugaucccaguacucaggaggcagaagcagguagaucucugugaguuccaggacauccagggcuacauagagagacauuguuugcccccaaagcacagacccugacaggccuguccaucuuaaggaacggaggccagagaccuguugguaguugaugguuugaugguuuauuuagaaacucucccugaugguucuugacuuggggagugaggagaagccacuucaaguuguagacaaggugugugugugugugugugugugugugcaagugugccaauguguaagugugucuguaugccuugcacacacacaguuguuucaagugugcuauguagccaaggauaacacugaacucugaauuccccuuuaucuguuuaugggcacacauuuccccccugagggauauaaauucuccuugaaguguugauucaccccugaaguagaaucaggucuaaaguggggaugaaucucaggguccuuccagguagaaauguagggcaacaaugacaguacacuguacccuccuccucccuguccuucuccccgcuucuuuuuucuuuuugagcucugagugacuggaagucauguagauuggcuggucccgaucuugugccuuugcuucccgggugcugagagucguguguucugaagaacagauuuaagcaggcaagcaggcuauguaagaugugugacagaauuccagaguugaagaggcuggauggccaagggaccuggcucuguccauccagccuucagucugccuuuucuucucgcugggagaguggcuugguuaauccacaccagugggugacuuuacaaauuaacucccgugaccuuggacuguuccauccauaaacacggcucccuaguuuaugaguugcccagcccaguguuaaaaaucuacggugaacuaagcccugggagaagccagugugaaacucaaacugagcagagaccagaucaaacauggagauaagacagcuacaguuucacuuuugggcagggccaagaauuucaggacuuucuuuacuacagauggggcguuauuuugcuuuccuaugggugugugugugugugugcugauuuaguuuaugauucauugauuuugggguuugauagcaggucuagggaacacauaaugcguuacagauauuugauuuuaaauguauuccugguacuuuuuggggggggguuguuuauuguuuugagguuucucuuuucccccggcuguccuagaacucaugcuauagacuagacuguccucaaacucaagauuugccugcuucuguuuccugaguauuggaauuaaaggcacgcaccaccacugccaaguuguuugccugguauuuuagaaagggcaauuagucaugagccugaggguuuuucacauuuauuuguuuugcuuguaacaaguuaaccagugacagguuuacuuuaguucucucugucucugucuuugugucucugucucuuaucuuuccuugacaggggggucucauguagcuucgguugaccccaaacucacuauuuuagccaccagggccuuuagcaccuagucuucugacuguaaguccucugagugcuggggucacaggucuaaccuucucauugaggaaacuuuggccucuaucucuggucaucaauacugaucuggagaucucugagauacuauuacuguggaaggccauuugauucucuuaugauggagccugaugagccagaccagagaauggcuccuauuaggcucauaaacuggaaugcuuacucacuggggaguggcaucauuugaaaggauuagaaggauuagggguguggccuuguugggggaaguaugucacuggaggugggcuuugagguuucaaaagcccaugucaagaccaguguguguguguguguguguguaugugucugucugucugucugucugccucuuuggaucagguuguagcucucagcuacugcuccagcaccauucaagccaccaugaugauuaaugggccaaacuuuugaaacuguuagacaaguccccaguuaaacgcuuuuuuggauaugaguuccuuaagucacaugccucuucagcaauagaacagugauauuggacaaccaggagcgugcuggaaaagugagaaauuuagaauuuuucccagcagugggaauuuccuguguccugaugccgaugcccucuuuucaagacuaaacugagaacuuugcuccuuugcugcuucccuccuuccauccuuaccugcuccagugaagaauuuguugacauccguaucucaggcacaagggggaaaacaaagggaaaauaaagauaagaggaggagggcugaguggcaaagugagugccauacagcuuagaacucugcagaaagcagaccacaaauuugccucuguuccugccaggcaaaauaaagagggaaaucugaucagcccuccugcuggacuucagugugcuggccauuaguggggugccuggcuccuccagagaguucuugcuucauuguagcucccaccacucuaaugugcuagacuucccauuugcaauugucuuuacuagauaaccaacuaaugcuuggguggacaacauugcacaauagagggcagagauuucagucaugugugucaccaccuacacagcuccaugaggagcauuuuugcaucuuugcacucccccacuccccggguaagaucugucuuguauaaugcauagcauaacuauguaaugguggggauuuuacuaaugcuauucacuacccagcacucugccgccucagggucacguguuuacuauucccucugcugggcaccuuugccuuggcauauagcuuauaacuccaggcucuguuaaagcuucccccauaguggagucuaccacauaauaaaauguacaguuccuuuuucauagccuuuauuauaauccagcuuaauacuguaugcuauuugauugcuucuccaacauccccccccuccaaauguaggcuccuugaaggugcaaccugcuuuauuucauugguugcugauagaaaauuuucaagugauccuccccaccccgccccccucacacucgcugcaugagaucaggugcugggaauugaacccagcaccuuaccugcuacacaugcuaggcaagugcucuaccaucgaggcuccaggaauauggaucucucuccuuuucucuccccacuccuccaguuacaguucuuuugccuugacuucacuugaacuagcucuguagaccagguuggccucaaagacucaggcguccacuugccucccaaagugcugggauuaaaggugugccauuucaggcaucagccagagauuuaaaaagaaaaaaaaaaauccagauauaaaaagaauacuguuuaucuccacuuuuagaaaauuggggagggauauagugcagagauagaguaccuagcaugugggugguccuggauugaagagaguagucugcaagagaaaaagcaaaagagauucucuaauagaggaaggacuccaugagaagaguagaaagaagguucuagaacaaccaaggcagggagucuccagacagaaugagcacagugugccgagaaggaaaaggccaaggcccgugacugagauccuugagggucuguaggugcugcacaguuauggaaaugauauccaggguccagccucucaguucugaagacuggguaacugccucuguauccaucagcuucugccaagauggagugaugagucuguguucaaaccgauucuuccuucuggccaagcauacgguggguguggugcacuggugugugcacgugaguaguaagugagugcguuccuuguuccuucagcccaggagcuucuggguccuuuggaaacaauugcaggagaccagaauaacacagcucauucaucacuggguauggcucagcccagcaucuugugucagaaacgauccgaggggcauguuugauggggauuagcgcugcucucaauauccugccuuuuggucccagcugacucugacauuccuugcuggugaguuccugcucauuucaguucuagcccuggagcagcagucaguauuaaagcaaacacuuauucugugugucacagugccaaggggaacuaucacuauucugauaguauguuaacuuacuuguggguuuuguuuauuacuguuuguuuccgagacagaaaucugccuuccaagugcugggugcaaucuuaccagagccuuaccccauagcuucuagguaugcacuauauaguucauugucuugaaaccugauguagcuuccucaaaagucacuauggaaauggacugacacaagccaccggccagugggagaaugggguuugaagcuuagcgacuguaaguucaucauguaauguaggagggggaagugugguguuaguaauaccuauagucuuaguucuuguggaguugaggcaggaaaaucccuugagccuaagugaagaugagguaacauagcaggacccugugucugugugugugugugugugugugugugugugugugugugugugugugugugacugacugagauagucucaauauauguagccuugucugcccuggaacucuucucauggccuugaacuccuagagaucuuuuugccucuguuucugcuucugccuuccaugugcugggacuaaaggcauaugccaccaugccaggucccaggucccugucucuuuuaaaaaauaaagcagaaagaaacaccauacuuggggcuggagagauggcucagcgguuaagagcacugacuguucuuaugaagguccugaguucaaaucccaacaaccacaugauggcuuacaaccaucuguaacgaaaucugaugcucucuucuggagugucugaagacacacuacaguguacuuacauauaauaaauaaauaaauaaauaaauaaauaaauaaauauuaaaaaaaaagaaacaccacacuuaaacugaugccuuacaagaacuucguacguguuuuguaccuguuacugugcagcuguggucgggacaaggguuaucagagagagaucuaucugguagaguuugagcucuagaugucaguggauguggcaugucacgggcuucggcuuugugccuuccuacuuugcagcuggguguaauuuucugcauucaccugguguuucuugcagcagaaaucaucacacccauaagagaaguagccucugaguuaaucuuaagugagguagaccucugggcuaugcuuaaguuguccgcuaauucaucacuugugcuggaaggaaugugcacucuccaaacagaugcuguagaggacuguuaucuccaccuugcagugaagugaacugagguucugagauuuaaggacaaagguuccugucgggggaaggacagggagagguguguguggggggugggacugggagagaaagggacaggcagguuugagacagggcuucucaguguagccuaggcuuaccuggaauucacagagauccaccugucucugagucaugggugcuggacauuuguuuauuuuaaagauuuauuuauuuauuuuauaugaguacaguguagcugucuucagacacacuagaagagggcaucagauaccauuacaguugguugugagucaccaugugguugcugggaauugaacucgggaccuccgguagagcagucagugcucuuaacugcugagccaccucuccagcccaggauauuuguuuuaagagugauagaacuaggaagcuggaggaauagggcagucgauaaagugcuuaccuuaaguucaaagacaugcuuuucugcugcugcuuguccuccuccuccccuucccucuuucucuucuuccuccuccuccucuuuucuuucaagauagggucucucucuacauagcucuugcuguccuagaacccuaucuguaaaccaggcuagccucaaacucuuaccugcucccgacuccugaggagacagguucucaaacagacccuuuugagacgggcuggacuugaacucuugaccuuccugccuuacuuauucugcuagugcuggcaccacaggcagcugccugguuuuguguuagaccuuuuuagugguggucagaggugccuugggcagcagcugcagagccacgugggcauagggaaaaugcccaggggcagggcagaggccaucagggcagcggagugagcagcucucauggcacgucagccuccaucguguccucggugugcacaugguuggaugcucgcuuugaguucuucuguaggaucuucccuuauccccaaauguuuuaguuauaaaaaaaaaaaaaaaaaaaaaaaaacaacuucccagaggugcaaggagccaccuccuucugcaguucauucugugaauggagcuuguugcuuugugucaggcauuugcaagugcgggucacucagagguugagaaguccucacccuggugcuuccuggaggcuggggggaggagggcagcgggauggggggaaagguuggccucccaagugcugcaaugaaagucaggcaccacuacaccuggcuaauuuuauuuuuaaaaacuucuguauauguguggccaugcacacauuuagaggccagaaggugucggauccccagagguggaguuacagauggucaugagccaccuaacaugggugcugggaaccgaauguggguccucugcaagaacagugcacaccuuugacugcugagccaucuuuccagccccagcuuguucaauuccaaacaauaagucaguauuuaggaaaacaaagcauuccaugagucaggauaagaugccugaugccccuucugaaccaugcugcccguucucauggguaggagauuuacaguaucauuugcugucuaguccauauucaaacacccccaacuaucccaagaauguuuuauuuaguguaggaacuuaaacgcaaggcaucucagacaugaccuccaauucuguacagucaagaauguaaagaaggggagguaguccugccuuugaucagccugccuaucccucuuucuucucccucuuggggguugagccaggaagcaucuuauuggauuauaggagucaagauucugguuuuguguuuuuaagcacauggauuucauauaagcuacaucuaugcgcacaaauagccacacacagagcucaaguuuguaauuuaaaaagacauauaaugucucccccuguaauaaaggcaagcuggcguuucuggaucugaagugucugguagugucugcauguuacuuccacaaggaacaaagggcuuugaugcagaugcugcugcaguuagucaugaaggucaagcccccaggucugucuguccuuuacagacuucuuuccucaaagcgggcaaucuaggagagaaagcugauucuguuugucccuggaggcaggccuggagcucaacuguauagaccaggcuggccucagacguguggcaguucugccugggccucacgugugguggauuguuuuccauccagguuuggagucacaggcuuguaaucauaaaaguuggaagugcaguuaguacacugcagaaugguuuagcagcacagcauacuuacugcucagcagaggcaagaggaacguuggaaguuugaagcuagccuaguccacacagugaguucugguuuauccagagcucaagcugugcuugucugcuguguaugaaacccuggacuuguucugcagugcugcauaaacuggucauggugguccauuccagcacaaggacauuuuugcuaagucguaagccuaggcuacaugaggcacugucucaaaaaaaaauuuuuuuuuuaagguagagaauaauagagaagggaauccagcaucuacuucugcccaaacauauauaucuucuucacucccaggaacacacacgccacaccugaaaacagcuauuagcaguacuaggcagggaacuauaugcauaccucuuagauggcugaguuuaaggccaaccugggccacgcaggcaauucaaagccagccaaggcuaugcauauauagugaggcuaucugggaaagauggaaaacaaaugaaacaucagacugaggcagagcgggacacuugaccucucacgucacaagcuucuggacuuacaguggguaacauccugcuaaguuggaagugcaguuggaacacugcaaaaugguuuagcaauacagcauagugcccaguggccgagugcugcaggcugcagacugcuagccugggacccagaugcaaucuuuauagucuccaucaaacauguauuacuugauuuugaacugccguacaaauagaaaaaaagaaaaugcuagaccaggcaccagaugugcacagaauacccagagcaggaaggaugaguggccacaggggaucggaggagaccagcuacugggcacagaguugccuaggggaguggccagggcguucuggagguagaaacugguuauugcuacacaagauggagacuauauccaaaccacugaauuuuguguuauuaacaguaguuuugauuuuaaaaauugauugccaaggacaaauacuaauuacuuuuaaauauuaccuaccaguuuccuuuugcuuugcuuuuauguuuuaaaaauuauuuauuuuauguauaugaguacaauauagaugucuucagaagagggcaucagagaucucauuacagauggcugugagccaccacgugguugcugggaauugaacucaggaccucuggaagagcagccagugcuuuuagcugcugagccaucucuccagucccuuguuuuuguuauuauuauauuuuaucuacuuuuggguuugugucugugcacacauaccacguugugcacauggagguuugaaaacaugagcgucuucuccugccgucauuuuacuuggcugcaugccuuugcccgcugagccaucuugccagccuuuuuauuuuuguuuccuuuuguccuuguugagauagguucucacuauggagcccagacuagcuuugaacucccuacuccaaccuguccuaucucucaggcaaugaccuaaaccaaccagugagucuuccugggcccaccuccugugaggaacuuugcuuugcagccuuuaaaacaaacaaaccaaccaggauucugagaagccccagcuaccugccuagauacaaucgauauguuguauauucagaaggaggccagggcuaguggcuuuccaggagagccugcacugauagcuugagaggguguuuaagagagaaagcuugagagugacuggccugaaguacccagucagcaaaaaagaggcccauuaagaaugaagguauuuaaagcuggcaucaauggggagaguuggguuaaugcacgguauuugcaggacugacuagagaaagggcuuugcccugugggccaccccccagccccagccccacccccaacccaacccuggcauccugugagaagccagggcuuucucugggagcuacacccaaaggcuuugcuuuuuauuuaagcaaaugaaggccuuugugggauauucagauggccuuuuaaaguucugccagagccaacaaagccaagguguggagccaacaucggcacagcucuuagaagcaguuccugcauuguccaaguacccagaggcuccuucuaaguggguccugugccagcgccaucugucccaucagcacuuugguccucuaccugcccugugggauguguugagcugcuccagugguuugucccaggacgugcugcccucccuccacagugcugcccccauccgcaaucuacagcaaugcaggucggccuggagggauuccucugcaggugcuuagaggguuuggguuaaagggcugguauugggaauagccagucauuguggccacaggggggggucuccagaauuuucuuauuucacuuccaucuucaacacuaaaaccugggccacauuuuuaaaaaggguuuuucuuuuguguauaugugcaucuguguacaaagguguacuagguccucuggagcuggucuuauaauugguugugaaccacacccaacgugaaagcugggagcccaacuccaggcaggaagagcaggacaugcucagagugauggccgucucuccagcccccuccccuauuuuaauccucucugcauaucucuaaggcagggauccuuucugagagucugaggugcucuggagaauuaccaguccaacacuguggagccuccaucugaauauccauguuccauauccauguucuuagcauuucagggacucaacuuucucugaugcccauucuccaaccuaaguaaacccuggcuccgcccacuccugagucuuuacggaugggucaggaaagcagaauagcuacccagggagcuuccuuuuauguccacagauucguuuccaaguggucugggaagggaguggcuggcacgaacagacacuguucccugugguaccgaagcuuugaugaggaggggcggggacggaucagcuuccccagaguggagcugugcaggcaccccccacagguaggggcagccacgccugcaggcaggggugaccaaggcuuagggugugcacugaggccagggagcccugcugguugcucagccaccugggcgccaccuacccugaggcagcugcagaaaauucuaguucugccaauugggccacugcaguguaaucacagcagcaauacuuaguagcucacuucauaggcucucccuucagauuuuuuuuuuuuuuauagagucuguaagaggcagugacuuuuuuuuuuuuuuuguuauuuugaaucaguguuauucuguagcucaggcuggccaagaauucacccuacaauucagguuugugacaaauuuccugcuucagccuucagaguguaggguuacagguaugacuuaucauccacggccauuacgucuguuuuuguuuuauguaucccaggucacccuuaaacccuguguagcccagguuggucucaaacuggaauagauuuucuugccuuugccuccccaaugcuacuguauccaacuuucuguuuuagaaagagggcgaguggguuuucccgaugccccacagcuaguucagauuuauccaaauuccaaccagcccuggcaguagcguggggcaccugugcuaaaagagcaaagggcuuugguuaggggcggggcggagugggcugguccaaucagaggucaacaaaggggccuucaggaagggguagguccaaucagaggagucucaguacaggaacagcucuguuccuuugcuaucuuuguuuccagucucugcuggccuuucucguuauccucaggugcccgugugacuggcccuuccuggugaagucagccaugaacucuuagcgcucaggauucuucuccguuucugucucucccuuugcagagggccacuuacuaucauuaccccugugccccgggacuagcuccaggggucaaagucccucuuaaagccugacuuuuggaaagagcaaaacaucaucuaucauuuaugucguuagauugcagcccugaagauguucuuaucaaaccgcaaagaaucugacggaacccacaggcucccugaguccuuaaugucuucgcccgauaaugcaacugagacccacacucaggguuuuggaagccaugucacccaguuguuugcuguugaccacagguuccucauucaguugggcucucaguuaaagacaaggaaaacguuuguuacguaaagagaggagagcaaccucuuuacuuacuuagauugagugugcauguauuguaauggcacaugcaugugagaguguaagugcauguacccauccaugcuuacacacauggaggcuacccacaggaucaggugccuuugcuguauuccuucuuagccuuauugucuuaagaaagguccucucggccuggucugcaaagccaguuccaggacagacagggccacaacagagaaacccuguccuggaaaaaaagaaaaaggaaaaaacaaaguuucccucacuaaauguaaagcuggcugggcagccagagagcucuggaucugccugucucuguccaccccagugcugaggucacaggcaugcaguuauguccagcuuccuaugugggugauggggacuccaacacaggcccucaggcuugaagagcaagugcuuuggaccacucaggcauucccucaccccugccccccaaauccaauuuaaaugauacaggaaaagucccacccccuuuugcagugguggggcuugaacccaggaccuccuucaugcuagggaagugcuuugcugagucgcaccccaccccuuuuagccuuuuuuuuguuagaagacauggucuuucuucuguguagcccaggcuggccucaaauucccaauucuucuuucucagucaucagaguggugggucccgggugugccgccuuguccuuagcuuuucuaagacaaauucuucucauacaguuccaugccauacagugagacccuguguagccuuaacuguccuggaacucucuguagaccaggcuggccuugacucgcagagauccaccugucuuugccuccaggugcugggauuuguuuguuuguuuguuuuuauuuuguuuuaaaacagggucuuuguauauagcuuuggcuguccuggaacucacuaugaagaccaggcauuugccaccauaaacagccuagcugcauccuuucgaauuucugcauccuuuccuguugagugugugagaucagcccuaugccuugcuguuuauguggcacugagaacaagccugcccugacguccuuguucagcuccucuagggcaggugccggagucuuguggauugaaguaggaaaagaggauucacaaguauaagaucuguaagcauagccagaauagccuccaaccauuagacugagccagaugugguagugcauuuuuauauuucuagaacuugagagaccagagcaagaggcaggacuauuggagaguucagccuggcuacauagugauauguugcccauccaugcuaauaugugcuugcuccagcauccugugcccuugagcccacaucugugcugguucagugcagccucugugccuuacagaugaacgcuaggaaggguguaggaggagccaggcaucagacguggcuucuguuauguuucucuuuagacagcccacagcggccugcgguucccccuccucuuuggcucaugugugggucagccucccaacugccucaccacccugcagauguccuuccccacaaggacuccucaguccugugaggcacagauucuagggacguucucaguccccaggggguggccagguaggaccuugugugacuugcucccaaguccugagcauuugcaaaaaauguuuauuauucugcuguuuguuuauugagaugggguuccauucuaaaacucaaggcugguccggagcugaccuggagcucgcgacaauccucuuccugccucaacuuucccauugcugaccuuacaggcgugagccauugugcccagcacugacauaauguauuaguguuugcucaacgccccggugugaagagcuuuauuuaucuuacagcugcauaauaguuugccccaagaaaaugccaucauuuauuuaguuaauccugcacugguggcuccuuggguugucccccaggcuugugcuuugcaaacaaugccuuagugagaaaccuugaaugggaauuugcaugugugcaaguuuccaauucuugauuccaucggaaacugggaacagacuagguaaagggauaauggagucuuuugaaagagucgcaggcauggagguaaaagauuugagaagcucaucuggggcagaugucacagcacucagacugugguaucuugaguaugugaccuacggcuguacgcuauuguacacuaaagccugcaucugauaucugcagccuggucuuuuuuuuuuuuuuuuuuuaauucgcuguuaauuguuacugucagaguauuacuguggugcccaggcuggauucaaacucacuccagccucugauucaugauccugccucugccguccagugcuggaaucacuacucguggugaacagggcuaaugaugagaaagggacccaccaaggucagaaaucaaccaaaagcaaccuagcugcuucuacccaguuaggguugaaguugggcucggagucagcaacugccccccagaaagcagcaacagucuccuuuugaagcauaaaaucacaagcagaucaauauucaggagacaaugaagaaggaauucauaaauugagguuuaguccugcgaugugacucuuuauacuauaggcccaaggccacucugaggcaggggucuuaucucaacuuuuaugggguuaaugcaggucagguuuuacuguaacugaaaggaauguagggcuugagggcuuguaguaaaaagggggguggcagaacaauaauacacggcguuacucugggcucuucagugguacuccccccaccuuuucggugcuacugagagguuugaacccagaaccucuggcaagcugcuaagcacuguaccacugagcuaucgccacagcucuuccguuuccuuuuuucacguuuucugaccuugaauucuuagaauguacgucccaaauggagauaccuuccccuccuccccucugagggacacggcauuguuguggggcuuauuuucugaguaaauuaccuuuccaggcaggcuguguaggguuagcaaacacucuuggaagcagcugccuuucccaucaaugcuugcuuguuuuggauaaugaaaaaugaugcuagcauccauuaaagaaaaagccgccucuuagaagcgcugguggacaagugggugcuugucacagagucaucugcugaugcaugugaccuggagaacgagaaacggccucucucugugacuuggacuccucgacauucuuugggucuguuuaggaguuuuguuuaaaggucggaggcggagggucuccgcuccuccggcacagcccacauuuggcaagagcucaggccucguguucuuccucuguagaagagguuuucacaucucauucuugagcuacugaaugaaccgaauauucuggauuuccaaucucagcaacuccagagccugaggcagaagaaccucuugagcccaggaguuaaaggccagccugggcaacacaggcugucugaaacaaaaguucuuacuuccauggcaacuuccccuguucucacaugggcuguggcauuucuguauucuuuugugcuugggaagugcggcccuggauugaugaguguuucugguuggcugguucuguugacucugagcugcccccagcaagaaggugaucagaagcccaaccucagcugggcacaauggugcauuccuuuaaccgcagcacuugggaggcagagaagcaaguggaucuucgugaguucaaggccagccugaguuccaaagagacuauuucaaaaccccaaaagaaaaucagcuuaaaaccaaaaagagaggccggagagauggcucagccguuaagagcaccaucugcucuuccggagguccugaguucaaaucccagcaaccacauaguggcucacaaccaucuguaaugagaucagaugcccucuuccggugugucugaagacagcuacaguauacucacauauaauaaauaaauaaaucuuuaaaaaacaaacaaacaaacaaacaaacaggagccuggcauggugguguauccuuuuaguuccagcacucaggaggcaggggcaggggcaggggcagggggaucucugaauucaaagccagccuggucuucagagugaguuccaggacagccagagcuauacagagaaacccugucuugaaaaauagaagguaaacaaacaacaacuauacaacccccagaaaacccagauggcucccaguguugccugugugugcaaguaugagugugugcgugcacauguguguguacacacgccauguacacacacgccacagugggaucuggaggucauaaaacaauucacuucaugcuucucugggguugaacuuggguuuucagguuuggcagcagguguccuugccagccaagccaccugucugaccugccuauuuuguuuuauugagacuguagccuagacaagcuuuaaaaugucugcagaugacaaugaucuuggucuucuugucuccaccuccacagaguuuggauuacaggcaugugccaccacaccuggcuccucguuacuccuguaauuacuguuaauuaaggacuguuuaugaccuugucauucuccacuucuucacagccucaguauuauuggguguguagacuuuggcucaugggguaccccucacacgaaacccuaauaacuauauuucuucgaguucguugaguuguaauuugcacaccuuacaauuugcccaguggaaaugcguguuaauuuuuauaggugcacucaguggcucacccgucacccggauccaguuuuagauuugcauuacucaggagcccccuuugggucaauuggcaaucuaauaccugccuugccucagccccaggccuccgugggccugcuuucugucugcaauguguccuggcugaccugaacucauucauggauguaaacuaggcuggcucagaguucugcaagccucugccuccugagugcugggaucaaagguugcaugugccaccacaccccgcagucucuucauuuucuaguagcugcguaaauaagacaaguacauuuuugggugagcacuuaaugcuuaguguaguugaggcuuuacauaccugugcuuuugggagggcuaggaauguagcccaaaggcagagcgcuggccuaacaugcccaagggccugcaugcuacccuaaacacugcaaaaggaaaauguggcguuucuauuuguuggggaguugugaguugccauagcuuaauuuauccauccuggcaacaauagauucauuguaagacuuuuagagguuuguuuuguuuuaaaguauaggugucugcaugugugccuggguguuugcaugugucugcaugugugccugaguguaugcacgugucugcaugugugccugaguguaugcauguauaccacaugagugcaugagcccucaggugucagaacagggcauuagguccuucagaguuggaguuacagggugguugugagcugccccaggguucugugaaccaaacucagguccucuguaagagcagugagcacucuuaacucuccaguuaacccuccagccaagccaucucuccaucucucagccaccuuuuuauuuguuuuuguuuuauaggcagauuugaaaagagaagggggagggaagagaagagaaaaguauuaauucacuuaucacauaucauucccauuucgcaugugaaucaaaugccuuugguauaugaacagaauuugcaaccaucccccaucaacuugggagcguuuucauggguacuagagagauggcucaacagguaagagcguuugcuguucucacagaggaaccggguucuguucccagcgcccacauggugguucaccaccaucuauaaccccaguucuaagggaucugaugaugccuuucugugaccucuguggcauuaagcauccaugugguguacagacagacagacauggagcuaaaacacucacacauugaggaaaaugaaaaaaauauaacauauauuuaguuauuaaaaaggaaugugccccuugccacccgccaucucccaaguccuaucuguagaucuuuuugaucugggacguucgagugugacaaaggaauggcacggggucuguguggucuuuugugucauucagcaucugcuaucuccacucuggcauguuagcuaacgcugcaguuucaccuuguaacacucccucccacgcacauacagaaggcauugcuguugauauucaaaacuaagccaaaucccagucggagugcaaaauagacguccugacggagugccgucacuuuagaacccagccaucaggguuaguaaguggaaggacuauguucucacuuuccauucccggacaagggagugaaggaaauuccccaaacccagcaggucaggcuggagaaagacugugugggagucgucuauauucaaccaguguuugagcccuacucuugccauuuaugcugugugaccuuggaagaggcauuuaacaucucugagccuuugcugagucauguuucccucuuuaugccugaugcaaugacuuacuuacuuacuuuauuuauuuauuuauuuauuuauuuauuuauuggugauucuuugcucacauuggauucuauaggagcuuggagaaaauuuaagaucugccaauuccugggcucuuccaucucuggauaucuguauugaguuaguuggaguuaggacccaggacuggguaguuuucaaagcacaccaggacaguaugugcacuguacaccagauccgagagggugauuauaggcauuuuggucaacaugcuuuaguccccgagugggacuggaggccugagagcucauaaggcuacauuaaggacuagagagggcuaggagggccuggcucagcggcacucaggccugccugccugccuuuugucgggggguggcagggguugagggugggggacucagcuguauggaauuuagaacaggauucucucugggcuugggaaaauccacagaagggaaaaguagagaagcagccuccuuccuaaucaauaagcaaacaagucguggagucgcccaaacagccacaggaaugcuccgugggcuguagccaguggcagugccagagagcaccccuguauuuaggcaguagggugcggugguauugucugcuugcagcuaaaagccaggacaccacagcccugacuuggcaugaaagccaaagguuuuuuuuuuuuuucuuucuuucuuuuuuuuuaaaccuguaugugucucccuuugucugcuggugucagcugggccagaagagaggauaucagauccccugaaacuagaauuacaggcagaugugagguaccuggggagggugcugggauuugaaccacaucuucagaagagaaguuaagugcucuuaaaaacugagccagcucuucaggcccauuucuggccccacccuaucccuauuacagcagguagggacaaauuccccaucuucuugcaccggauuucaguuucucuuaaaagaauugccuccucaccggacagugccuccaggaacauugaaaccuggguuguggacacuggacugucuaagaggggccuggagaggaaaaugacuucaagcugcuguuucuuuuccuuggucuugacaugaaggacaaguagauggaggcgaucuuggcucuuuagauggaggagaucuuagcucuucugaacugaaggaacaggggccauugcugguugcaagccuauguagacuucaauaccuaccagcuaccguaacuucaauuccaguacuguggucacaucugcuguguucucaccuggcucuucugugcagcacccaggcugugacaggcacaaggagcuugggugggucuucugcacuacccugugccuuguggcuugagcaugucucuggaaguccagccuucccugcuauccuugauuaaaucagucccacccaccuuggucccuguuaccuucucugucugauauguguuuguuaccccagcugccuugggucacaacucuugggaggaaagaaacccacauauuuuuugagaaagaauccuuacauucuugagggggugagugggggaagugccccuuggcagaggugagcugugguguaaaagagaggcaagacuggggccugaacccuugaauguguuuaaccacauucaccaagcugcaagacuauuaacacgucucaugucugaggcugauggcagguuuuacccuguugauuguaguuggcucacuggaguuaccauggagcuuggaacacauggcgagguagaaccugggcagauaaucacugccccaaugucuacagucagcaugaaugaccuuacaucugggggugggggggcaguccugggugaugauggaguguccuuuguccuguuuacucucagaagucaggguuaaaugagccugagugaauucucucccuucugugccuuugcugggcucuccuugcugcacuccucuggguguuaucccuggccuccuuugagauguuuuuguugauguuguuuuuugagacagagucucacuaggaguccacucuaggcuccaacuugcucuguagccucuugauccuccugccuccgaguguuggaauuaaagggguaugccaccacaccuggccuccuggucugaauuagugaaguuagugacuuuguuuuggaccaggacauuuaagagaaguugggagaaaaucugguaacuuuaaugcaaauaaguuuccuguccuuggaaucccccccccaccccagagucuccuuucaacacaggcgcacauaucuauggcauuaggaacacaggcuggggguuugcuuguguaguaugaccuuucgagcuccugguccuugcaggaguggggaugggugaccuauuaggggaaauacagcuuauuucaguuuaugacaaguggugacauaauguggagguuuuguuuguuuuuuucuuucuuucuuuuuccuuuugguucuucaagacaaggugucucuguguagaacucuggaacucuguauaagaucaagcuggucuugaacccagaaauuugccugccucugccucccaagugaugggacuaaaggcaugcuuuguaggagggagguucuugagucuggcuuuagacuucuuccuuuguucaaaccucuucuguuaguauccuugugguucugaggcccuugucuacggaaugaucuuuugcugguagcuguagcuacuuccuguuaaucuucacuuaauagccagguaaccuaggcgacucgccacaguguagacagagaccacagccucuugucuguuccuagccauguggcugggccacauccuuuaccuaucuguguuucugcuauuucauuugugaacaagaguugcuaaaugccuccuacuguauacgccugacuagguguauccaacccagggcuucuguaccuaauaaacagaacauuauaguucuugucuucagcuuucaagagauggacacaaauagcgaccuaucugagugaacccauguguccuuggcaacaaaggguagcuuguccaugcccuguuucuuucuuucuuuuuuuuuuuuuccauuuuuuauuagguauuuagcucauuuacauuuccaaugcuauaccaaaagucccccauacccacccacccccaccaugcccuguuucuaaagcuauggugacaucuccugcgggagugguuguuucacaagcuuguaguccuuucuaguuuuguggacaccuaucaaagguaucaucaaccucauacaugagacauguuaauauuuuacaucaaaggagggaguuccggcauugcauugcccaaugucaucuaagaaaaugaccuggggggagguuuucuggguggugacaucugugaagacuuuagaaaggaauacugaaccacaaaacaagagacugucuacuccuguccccucauccuucaggugaaacuuuuuuuuuuuuaagauuuauuuauuuauuauauggaaguacacuguagcuaucuucagacacaccagaagaggguauugggucccauuacagaugguugugagccaccaugugguugcugggauuugaacucaggacccccggaagagcaaucacugcucuuaaccgcuaagccaucucuccagcccaggguaaaacuuuuugucuucuggucuucagaguuugagucagaaaauacagagguauuuuugggauacacaguagcaguguagcucuguaacccuggagcucagaaggaaaacucugaucauaccuuuguuaccuugagccaaccaccuguguauaaauaaaugguccuuuaaguauagcugaacggaggucucagaguugucuguggaaccucucucgucaaggauacucagagaagagguuugaacaaaggaggcagucuaaaaaaagaaacaaaacaaaacaaaaacaccuguucuucauguccugccuugugcaugguaugagcaggguucuauuuucaaacaguuucccagagacuggaucaccuauuaguugcuaaagcgaucaaccaugguuagcugcccuuggugacaggacccuguccucgagccccagcauuuucugugauguucagaggcuucugagauuccuugucucuacccacucacauuccagagauggccacccuaguggaagaagaaaugggauccuucaagugaggcuggccuuggcucgauggcaauuacuggaaaagaauguagcgaaggcucgcgcuugcccgcccgcccgcccacccacgugaccagaggcuuucaccaacccugccuuuuauuuguauugaauuauguccccaggguuuucugcuguuagcuacuacuucugccaagccugcuaaaagauggggugcuuacaaugaauauaaaacuuaggcauacuaaaaagacauucuugguuuuuugucauuuaaagaauuuauuuuaauuguaaucaacaaagaaacaauaaugucacacacacacacacccuucuuggguggguaguuugaggcagucugauguuucuugggcuggccucuaucuaaucugcuauguagcccaggaugaccuugaauuucugguccucuuuccacuuucaagugcuaggauugagaccagcccuccccugcccccuauugguaauuuaacucaaaacuuuacacguguuauaggcaaaugcuuuacuacagagcuguauuuagggggaaaaaagcccaccucaaccccucuucuaucaguuuucuccaguuaucauucaugcccaugauagagguacuagcacgggcuagucuguguaugcaaaguuuucgauugcauugccaacaauugggguggggcagggacagucuugaauagcagugaagagcccucauuuaggggugaaccaauuaagcucugaacucagcaguguauaauuucaggaaaagaaagcccaugcugaaggggccucagcaaggcugggaugggggcagggagaaguugcaccaccccuccccaguagcucaguggcauaucaguccaugggauauauguaacagcaggagcauaaagcuaaccccaugagguuguccucugacccccauauauccccugccacauacaccccugugcacauauauaguaaggggcuagaggaugaaaagaauuaaguggguaaaaaugcuugccgcccagccuggcagccugaguuugaucccagggaccuacauggaaggagagacuugaugccugcaaguugucaucaucugaccuacacacacacacacacacacacacacacacagagagagagagagagagagagagagacagacccauacauacaaaaauaaaagccuaaggaaauacaaggcaaagaccaccaccagagcaaggacccucuauagagaggcaaggaaugcaaucaaggagcaagagaucucagauugccuucgucuaaaucccagccuugccgauuuccgcaucuguaaaaagaggaugugccagaggcgugguggcgcacgccuuuaaucccagcacucagaaggcagaggcaggcagaucucugugaguucgagacuagccuggucuacagagugaguuccaggacagccagggcuacguacagagaagagacccagucugaaaaagcaagauauagaaagcaaagcauauaucaacuguauaaaguucuggguuugaacgguuuaauguuuguaaagugcuuaaaauggagccuggaacgauaguguucugcaaauauuuaaaauguggccaaaguaguugacaagaguaauugaaaguauuaguucagacuuuccaaucaugggauugcaggugugcacuaccacacccaguuugagguuguggaguuuccugguaauaauggugaugguggugacuacugugguagguuuuccaauuaagagacagaugcucaggggucuuaauucccauggggaccagugcauagcacagcugguuaaggaaaggugucccacugggugagguugacuuagucccuuggcagcuuucuuuauucaguaccuuccccuggggaaacaucaaugcacacccagcuccuugggcugaucuugguguucucagaguucugcauagcugagcccgguggaagacaacuucuagaaccuuccuggagccagcaagccccuccaacuuucccuuauuucucagcccagaggaucugguuuuacagaaagauaaugagccuuaaccagcaccuggaaauucaggucgggccucucuugucauacuuacaaggugucacuucuccaagggugaggccgagucgccauuaagaggugccuugagcagguuaauugccucgcaccagguuauuuaccaagccucucagcucucuuuugcuaccacccuuggcagguccagucauguuccuguugguuuuucacuggcuagauuugugcgggcuggagaaaggaaucaaggccagcuccuguucccugcuuaugugacaggcccccaaagaugacucagaugccccucccccucaccccaguaccugugcugcagguugagaggguuucuuuaagagcaccuuuaaauguuccuaaucuggacuuuaaaagugcuaacugggaacuaggggagacggcugagccuguaaggugcuugcuaugcccugaagaaagucugccacucucaguguaggacuuguaaucucaguaugcacgggcagauaccagauggaguccuggugcuugcuggcuagccagccugucuuacuuguugaguuccaggccaaugagagacucuagucuuacaaaacaagguggauagcaucgacugcacagacagacagacagacucagucucucucucuuuuccuacauauccauucuucccauaagaaaggauaguugcuucaaguuuagacagauccuccugugacuguuaucucucauuugccuuuugcuccaaaguguguauuuuugccagucagacugguggugccugcacccucccucuucuugcucacugaaacaacauucauaucuauuuucucugucaaguacaggggcuuuuggcuucugagauguuuacaagggugaccccugguggaagaaaugagcacuguagcacaggcaucuccuccuggggcagaaaguguuccguccaccugaauguaagaggcaggggaguagggauuuucauaagagaaugcuuaggcaaaguagaaguuccguuguggggagugaugggcaauuguuugaaaguuuggaaaguaagcuaacuucugagauuuguugugaauucauucaaaugugcccucugagauuuuuuucuauuacacuucucuuuguguauacacacacacauacauacacacacacacacacacacacacacacaccccuuaugcccaugagcacagaacgucccauaugguaugccugaggaagucugaggauagcucacaagucaguucucuuagcuggguagugcuaguacacaccuuuaauccuagcacuugaggcagaggcagaggcaggaggaucucugaguucaaggccagucuggucuauagagugaguuccaggauggucagggcuacacagagcccagucuugaaaccccacuucccaaccccccuauacacaguuaguucucuuaucauuugagugaguucuuucacugugggguuccaggaguggaacucaggauuggcuguaagcaugcuugccugcugagccaucuaggugccuuggguuuauaaggcaggguuuccuacagccucagauuugcuuaccucuggaaauguaaccaguguuccuugcccccauaccuguuuuguuugugugugguguaugugugugggugggucugauguuugcauaagugcagguacagaugugccauggagggguauaaaggucagaggccaacuuugggacucuucuguuccgucuugcuuugaggcagggucucuugucucugcagacuuggcugcauacacugagcuagcuggcccaugagcuucugggugaaucucccaucuugcugcaggagcgccaggcuuauagaggcacauuaccacaucuugcucuaccugaguucagggguccgaacuuuggucaccaugccgcgcugcaagcacucugacccgaugagacauuucccggucugguuucauauuaaguaucucuuuugcuuucacucugaaaaugaaagauuugcuuuauagacaagauacucauugacgacuaagugaagaaaaccagccaaccaaucaaacaaacaaaaaaccacccagacuccaaaugucaguugcccuguauuugggaagaauuuaacgaugaggccaaggcucuccggguaggguuguucauugccaguuuguugaguuaguguauauuuuguaugaugugcuagaugaaucagguucccuuucuggagaagaaauguccugucugugaucuguccacuuuccuaaucucugugaucuccauccuguagugagauuugaaggaugcacuggccggccaaggacagccuucuuuucggaagacucccgauucaaaguggcgacagacggcaccaucacagugaagcggcaucuaaagcuccacaagcuggagaccaguuuccucguccgcgcccgggacuccagucauagggagcugucuaccaaagugacgcugaaguccauggggcaccaccaucaccggcaccaccaccgcguacguacuuggggguauuucuuagauauguguauauuuuucagggagcugucuaaucuggggggccucuagucuuagcacuggggacuuguugggcgagauaauuuuaugggaagacucuaggaugcuacguggcaucccugaugccuggaauaccugcagaagaaccuccauaaacucaugacucuuagggugggaguggcaaaaauaccccccauugaggacagucuuucguucugacugaauccauuccuauugggcuugggguuugcuguuggguucuguggcucugguaguauggggugaugaggaagauacuggcccugccuggauuguuagcccacaguugcuuucucucugacaacaaccccagugacaccagaggggucguuuccccugugcagacugagugaauuuacacacaggagacaccgagaucauguacauacacuugguauccacaaggaccaucuucuuccuuuaugaauaugaaaaccuaaaugcucaauaggggugaggauauuugccuauagccagcauguccugcugcgaaugcaccucuacauaagauaaugcucaacucaugacucuaugcgacagucacuguugcacccuuauuaguaagucugcauauguucugcgcggacagaguuguucucauaguuauuuugguuugagcccagguuggcuucaaacucauagacucuugaucugggacuguggguguguacuaauagguuucauacaggguugguucuuccucguuuuucucuuuuuuggacaggauuucuuauagccacgauggugcccagcucacuguacugcagaagauaacuucuaauuuuucauuuccggagugauaggguuguaagcuugugccaucacaccuggguuuguggggcucuagggauuaaauacauggguucaugcaugcuagacuuaguacucugccaacugagcuacacccccuacucuagauaccuuaaaaaaaaucuuguagaauccuuucugucccccuuuuuguuuuauuuaaaggaugguuuuguguagccaagauuguccccaaacuugaucuauagcccaggaugaccuugaacucccaauccuccaaaguuugggauuacaggcauguacuaccauauuuggcuuugaaaagaaaucauuucuaucugcucuugguugacuaccuaugugaaccuaagcuauggagggagggcugaguggaagguuagagucuuaucaaauacucucuguuggccuugccuuccuggagagagaaugagugucuuauuuagcaaggagggggaaggaagaccaguaagucuuugucccuuuuuagagcugaagagacagcuguagguuuggcuccccaaaccuccauuagguaccauagaacagccaggacucagcuguaggagacacaggcucccuuucgggccucugcagugcuuacacaugaauggugccuucaauucaugcaaacauacacagagaugauaaacagauugcuuguuuguuuuaagucuucuuugcacugucguuauguaagauccuucuccugauguuugcagugcugcucuuagguccugcgcagucccgaaaacccguacagugaagaggcagauacacagcuuguguguggucuagacucugcuugggaaugucccuggaggaugucaccaaaagccacauaaaugcuucuguccauuuugagaauggucucugggcacuuccuauggugucucucuaggggacauucuagacacgcuuugauuucugcucccgggguguggauugugccaaagccuuuaaaguugauuucuguucuguucucugaagacacuugagacuccugagauuuaauaaucccggauguaguuuuccucuccggaauuagagaagugaagaacuuaguucuguuauguuagucauggcuuccugagacccaagccccagcuugcuggcagucaagcaugcaugcauguucagcacaguaaguccccaccaggcaguugacugugggagcuuucuaagaccaacaacaguuuggagguugucuuugcccugguccccucacccucauccuccccuccgcugacuucauucuccauuucugccauaucaugauuugauucaagucugcauuuuggaaacccccaagccaggugugguggugcacaccucuucuguuuguuucguugguuuuuguuuuucaagacaggauuucucauauguagcccuggcuggccuggaacucacaguuuagaccaggcugucacugaacucagaaaucugcuugucucugccucccgagugcugguuuacauaguaaguuucaggccagccaggauuaugcugugaagcccuaucucaacaaaacaaaacaaauccccacuuuagauauugggacaguucucacagaagguaugugauccucuggagaccgagggggagcuauucugguagccagguagccagucccagagccagccuuuagcccaugcuggcuuuuuucuguggguaacagaugcagggaugguaagacugugugugugugacagguaugugagacugaguucuagaauacuuggucacauuuuaugucugucggucuuuccuguuuugauucuugggggcaggggggaccaauccagaagggcugaaaauguagcucaguugaugaguucugauuuagaguacaugaggcccugguuucuauacccuacuaucacauaaaugcacccaucauccauccuuuguugaguggaggcaggaggaccugaaguucaagaucaccgauggcccgcauaauuugaagccagacugggcuucaugagauuguuucuaaaaauguuccaaccaaacaacagacagacaggaaagagggccuggcuagaacuuggcaggcuguggucucuguugauguagugucuuccuguggaggguaaggaugagaucuuguagaaacuuuguuaccaggaaucauucuaaaccaauccaggaggugucgccuuucaucuuaggcuuuccuguuucccugagugugcaggaaguuaucuuuauugcacaugagaacuguucaaugcaagucuccagguaauuuuuguuuccuagcccagcugcuucuguuagaacaaaugcaacccuuacagauauaacacaauaagauuaacauguuuguaucgaucucagaaauaguucuuuuuuuuuuuuuuuuuuuuuuagauuuauuuauuauuauaucuaaguacacuguagcugucuucagaugcaccagaagagggcgucagaucucauuacggaugguugugagccaccaugugguugcugggauuugaacucaggaccuuuggaagagcaguuggugcucuuaaccacugagccaucucuccagccccucagaaauaguucuuaauagcaauuccccaaacucguugauugauagcuccacuuuggugagcuguaucccuagggaaacaaaagaagagaagccuagaacucccaaauagcuaguuacugaauuacuucugacauuaucaguguauggcuuaaagggcauguaccauauaaguuugaaauaacuuuuaaauacaauugucaaaugucuggacccacaaauuuuguaugcacagugauuauuugaaugcuaaacauuaaggauuuaaugagaacaaccugguggugauggcacaugccuucaauuccagcacuuggaaggcagaugcagguggauuucucuugaguucaaggccggccuggucugcaaaacaaguuccaggacagcaaagggcuacacagagaaauccuaucucaaaccaaccaaccaaccaaccaacaaacaacaacaaaaaaacauacuaacacggguggugguggugggguuugcuuggguuuuuaacucuggagguucaagcccauaugauacuuuauucuguccucuaauugggcuagcguacuggagaguaaaccacuugucauaugauccagaaagcaaagaugagacucgggucugaauaucuucugugaucugaaggccucucauuagccacuaaguuagggaaccaagcuuuuaggcauaggaacugugggaagucagcguccagacaacaguauguuuauuucuuuggcuuaaacuuuaacuguucaucuugaaugguacagguaauuugucauugagaaugagucacuaaauucaagaugguggacguccaugggauggaugaacuguuagacccguaugucuucugcauuaccucauuuuguuaaucuucuuuucucuuaggacccugccucugaauccaacccagagcugcucauguuucccagcguguacccaggucucagaagacagaaacgagacugggucaucccucccaucagcugccccgaaaaugaaaagggcgaauuuccaaagaaccugguucagguaggagaggaaguugguggcaggcucugcccucuugagagaagagaaaaugaaaagaccccauguugagaucuucccuggccaguucugauccucuucuguuuuguguucagaucaaauccaacagggacaaagaaacaaagguuuucuacagcaucaccggccaaggagcugacaaaccccccguuggcguuuucaucauugagagggagacaggcuggcugaaagugacacagccucuggauagagaagccauugccaaguacaucgugaguaauuuuguagacacuuguuggccacuggguaacgguugucaaauuuugggagcagcugguguuuuauccccaguuuggaugcccuggacauauaaguagcuuaacuuaucuuaaaguugggauggugaguuguugauguuguagggauuccucacaucauacaugagcuuagauggaagcuguaggagugggccuggaggaauggcucaguggauaagaacauuuguugcccuugaagagaaucuugaguugaguucccagcauucacauggguagcucacaaccaccugaaacugcagcucuggguguucugacaccguaugaccucccuugauaacugcacaaaaguguaugcgaacacacacagaggcagagacaggcagagacagggauagagauagagacagagacauacauacauauacaugcuggggacuagccugcucuaacagguauggaggugggggagccuuggauaaagcuaaaggcuggugauagcuucagaacucuuccuugcuguuuugggggucagaagcugucuggcaauuuaacucucucacuauucuguggcuaaaagcugaugauuucuggcaauuaacuccugcugauagcagcaggggauuaagaaaagaaguuaguugcuuaggcugucuccuuuuugacucugaggcugagaguucuguuaacucuuugugggccagagagaaaggaaaagacucuacucacucuggaugaagcagagaaaagaaucuccaacaaaucuuuauuucuguucucaguauacacacauucucugaaaauuaccucauacagcuaucagguagaauugauuacaugauuuuuuuuuuucuuuuuuucuuuuuucuuuuuugguuuuucaagacaggguuucucuguguagcccuggcuguccuggaacucacucuguagaucaggcugaccucgaacucagagauccaccugccucugccucccaaguguuaggauuaaaggcgugugccacugcugcuaggcuuacaugauuuucuaaacacuuuuccauucuguaaguucauaguaaaagcagcaguucaugucauaagguuuaaggaguuagagcagaaauguuuaaucucuucccauuaagauaguaucugacuaaacaucugcuaucuaucuuuagcucuauaaguucaauauaaguaaauaauuuuuuaucacaaauuagcacgguuuuguggagauaaaucaccuaccuuuugucuuauuaauuuuaaaguuuuauauagauaaacuagucaauauuuuauuuguugucuuugcaccuacaauaaauuauccauucccaguuuaugaccuuucguuaccagauagugaccuuguuccuaaccagaaggaauguuuuccuuggucauaaauuuguuccaagccugcuuucuuuuccuagugcaauuagccugugacacaugaagcauuacagggcucuguuugcagcuuuuucuucuacaggggacuugagauuacuuguaucaauuuaggaauucuaaauucaucauuaucaguauuuauguaaucauuaauucuucuacacagcauuacuguaugaaagcacaucuucauauugauucggcaggaaaugugcccaauugggugggcugaugcccagggaucauuaggcuauguaauagugacaggaaaggcauaucagcaacaagauacaauccugggaugaagccucuaaggacccuguguucucagagcucacccauuguacuuauucagaagggugggccaucuccagaaagcuuacuuguaugccuuagccuuuccuagaugacuucugacuuauacacauacauacacauaaagugaaagauguugucuuggcucgggagauggcuuaguuguuaagagcacugguuguucuuguaaaggaccugagugugguuuuccauacugacaagguagcuuauaaucauuuguaacucagguuccaaggaacucaguguccuccauggguaccagcucacauaugguacacauaccuaccuggagccaaaacacuuauauacauaaaaaagggagaaagguugggcacuagagagauggcuuagcaguuaagagcacuagcuacuccuucaaaggacccugguuuaauuuguagcccacauggcagcucagaacugucuguaacuccaguuccuaaggauucaacacucuuacucagacaugauguagacaaaacagcagugcacauaaaaaaaauaaaaaauaaauaaauauaucuuuuuaaauuggcauccugccugcauguaugacucuacaccaguagagaucaucagaggucauggugguuaugagucaccauguggaugcuaggaauagaacaaaggaccuguagaagagcaggcaaugguaguaaccucugagccaccucuccagccauauauauauauauauauauauauauauauauauauauauauauauauaauuuuuuuuaaaugucaacuuguucuuggggagaaauuucuuaccuagaugauacuuguucugauaauaacuauagggagcaaagcucacuucugagacuugguugcaaugugaacuuagggaggagggagauaaucuguaggugccaaauauagaaaaaucucaggaaaauauuagacugaaauagccagagggaaaaugaccccaacugaaauuuguguauuaugugauaaaugggcuggcuggcuggugguugucucuagcuuugagacuucaucaugaguucauuaagcagcaacacacaauguggaaaauucucacaugaaggugucauaguagaaagaguggaggcuagauggagccauucuagccagacucgccacccuggaucuucuuccaaguaacccucacuugacucucuugcagcucuauucucaugccgugucaucaaauggggaagcgguggaggaucccauggagauagugaucacagugacagaucagaaugacaacaggccagaguuuacccagccggucuuugagggauucguugcagaaggcgcuguuccagguaaauuagucucaaggaacugaguacccagaaagacauuuggguucuuuagaccuugaaggaugggauuagagaucgugucacugaaguuccgaccugcucuuugaaagccacccugagggaugagguggaggcaugagggagcaaauauaaaauucuaccuguagaaacauauaugagcuugguggugcauguauauaacuccagcucuaagggaugugaugcccucuucuggccuuuaagggcaucuacuacuacuacuacuacuacuacuacuaucuacaaguguacauacuacuacuacuacuacuacuacuacuacuaagggaugugaugcccucuucuggccuuuaagggcaucuacuacuacuacuacuacuacuacuacuaucuacaaguguacauacuacuacuacuacuacuaauaauaauaauaauaauaauaauagaaggaggaggaggaggaaaauaauaagaagaaauaugaaaagaaauaaaauaagaacgggaaggacuugguagcgauauuuauuuauugccaacaccaucuuccuuuccuccucacaucugaauuguaggcauuaaaaguugaguucccugaccauggcucguuuggugugaugcccccuugacugguagcuugcugagaauuuuagaaauaaaaacugugacaaagugugcuuaucuucuggaacaggauuguucugaauaguugugagcaaaucccaggguagccauugcaacccauuuaaggccccucuccuuugacaggaaccuccgugaugaaggucucagccaccgaugcagacgaugacgucaacaccuacaacgcugccaucgccuacaccaucgucagccaggauccugagcugccucacaaaaacauguucacugucaauagggacaccggggucaucagugugcucaccucugggcuggaccgagaggucaggcagaacucgggggauggcagaggggcuugaagggcaaauauacauuaaaucccauggacaguguaacccucugcuaagccuaguggucaguuaguguaaguggcuuggcuuuauaucuaaauaccugugcagaagcucugugccuggggacaggcagccugggcaguuaagcacguggucaaauacuuuucuauacgcaguaagcugcacuggguuuggggugacugauggggaguggguucugauuccauguguuuuggugucuacagaguuacccuacauacacucuggugguucaggcugcugaccuucaaggugaaggcuugagcacaacagccaaggcugugaucacugucaaggauauuaaugacaacgcuccugucuucaacccaagcacgguaacucuccaccuucuuuguuccaugaagggcccuucauugcucacgagcuaaguuuugccccugugcccuggugaacccuuuaaaaacucuucccuagguuagugaaugugagcuucagacuuagaaaccaacauccuagagcagcuacaaucuuugaaaugcuucuucuaucuuuugccuggggccauuggcacgugaucguguauugccgaaagcuccugaguccuugcuguccuuaccucagcauaucuauaguaucugugggucucacuuacuccuaacauuuccuaaguuuauauuccacccuguguuaccggagaccugccagcucaaagcagacaaguuuucuagucuguggaacuuacaauuuauaggaaauauauaauuuuaggaggauggaugauuugagccagaucuuacuguguaacccauccuggccuccagcucaacaacgcaccuccuaaaugcuggguuacagcuguaagaugccauguccagcuuuguuaagaaucacuaaaugccaaauaucaaaugaaugaaugaaugaaugaaugucaaaaacauucaaggaaaagguuuuaagagccagauaaaggaacuucgucugcagacucgaguacgcuugcacacacauacaugcacacagaacuuaaucaaauuaaaauuuuauagcccacguuggcaggcagguuuauaaugccauggccaucuuuuuagccuuagaagagaagaccauauguuacugagugaguuagaaguugauauggugguugcuuaguuagcagaggcccaaauaguguagauucaaaaggcaggguugauuuuuuuuuuuuuuuuuuuuuuuuucucuuucccuuuuguuacaauaggccccagggacaacugauuuaucuuauuuagugucuacuaauagagacuagagagaagaugggugugggagcaaauaguacaccugucuuaagaucaaaguaagcagacaaugggacuaacagaggguccuuguacccagggccucagaaagcuacuucagcguguauagaggagggugcucggagcugcuaguugaucuacugaugggaacugauggccuguucccagggcucuuaccuccauccuuagagacucaugcgaguuucuugaccucacucaucccaccuaugucuccagaauuggccucaguaugguucccauuccuuuagcccaagcccugggucuaugcuuacugucaucuugucacuaaugacccaauuuuuccuuuccucuucaguaucagggucaagugccugagaaugaggucaaugcccggaucgccacacucaaagugaccgaugaugaugcccccaacacuccggcguggaaagcuguguacaccguagucaacgauccugaccagcaguucguuguugucacagaccccacgaccaaugauggcauuuugaaaacagccaagguuuguacggugcuuagugaaugaugugccacuggcugagggucucucgucccacgaugucuucucgugggugguucaacacuggcagggggagagguuggaagucugagggugguacugacgugcuggggcuugcagaaacucucauggcuguuuugcugggucauuagaagugagauugguauggcuccuucgaaaaauauucuaaagccugaggcuaggcagcagagccugugggucaugaccccuuuugggguaggggggguugcuaagaccaccugaaaacauauuuacauuauuauucauaacaguagccaaauuacaguuaugaaguagcaaugaaaauaauuuuaugguuggggucaucacaacaugaggaacuauauuaaaagcucgcagcauuaggaaaguugagaaccacugggcuggaaagaugauggcuccgugguuaagagcacuuguugcucuguagaggauuuacauggcaggucacaacugcugguaaaucuuuggaauauguccaaauuaaaaguggggaagacuuacugguaaauuuagcaaacguuaguuaguagaugccuagagugucuauagagcuuuagugcccucuucagcaagugagaagccauguuugagaacuacugucuaccaaaaaaugguaucugagccagcuggugguggugcuggcuuuaaucucaguacuugggaggcagaggcaugugggucucugugaguucaagaccagccuagucuacagugugaguuccggguugcuagggcuccagagaaacccugucucgggaggaaaaauacaacaaaaaacccuaaagauuauagcugaaacuaaaccccucaaaaaaaauuuuuuuggacuaaccaguuuuuaaagcuuauauauuuguucaguggcaguggugguggaacacaggaccuuaagcaugcugggcgggugcucuaccaccgagccacacaucugauccugugguauuuuaguuuugacuuugucuuucuccuguucucuagggcuuggauuuugaggccaagcagcaauacauccuucaugugagaguggagaacgaggaacccuuugaggggucucuugucccuuccacagccacugucacuguggacgugguagacgugaaugaagcccccaucuuuaugccugcggagaggagagucgaagugcccgaagacuuuggugugggucaggaaaucacaucuuauaccgcucgagagccggacacguucauggaucagaagaucacgugaguaggaucccuuucaguggcgacucuugaauggguguugguuuguagucacacuucuuuuuugagacagggucucaccguaguccucacuguccuggaacuugcuuuguagaccagauuggccucaaacucauagagcuccuucuaccucccuaguucugggacuaaaguaaaggcaugugucaccauggcugaccacuuuggcuuuuuaauacauaauuuauauauucauuuauguaacuauaaauauagccauuuggggcuggcgagauggcucagcaguuaagagcgccgacugcucucccaaagauccugaguucaaaucccagcaaccccauaguggcucacaaccauccguaaugaaaucugaugcccucuucuggugugucugaagacagcuacaguguacuuacauauaauaaauaaauaagucuuaaauuaaagaaaaauauauagccauuugucauguaaugauaagacauucugauuuauguguccauggcaagggggcugggguuucacugaagaauugccauuugguggaggucccaggguaucacacgccccaccuuuuuuacuaaaggacugggguccgcaucaacauggaagcucauaagcauauguaacucuaguuccuggggaucugauaccucuucuaaccucuugcacuaugugggacacauauauacacucaggcacacgcacauagguaaaauuaguguuuauaauauauaugcguauauguauuuaaaaggggcaacuguguaacaagugaagaggaccugugaccuucuucaguuccuuugcuguuccuauucucacccagagcuugugcccucagguaucggauuuggagggacacugccaacuggcuggagauuaacccagagacuggugccauuuucacgcgcgcugagauggacagagaagacgcugagcaugugaagaacagcacauauguagcucucaucaucgccacagaugaugguauggacaccguguggucccauccccauuguggccugggcuccauccuucuccagcuugcuugcccccucugccucugccuuacuaggaggaggagacuucauucuuucuuuuaucuguaacaaacaaacaaucaaucauaacauaaaacuuuugguaacugaauuccaaacuuuagaucaaguagacuuucuuucccucuucucccuuucugcacuugaaucucacuccuuccugcaggaacuugguucaugguuaugaacuuacuauuacuuaaaucuuauaauucuucaauuuauaaucuuauaaucuucaacuuuucucucuuuuauuuugaauuuuauguguuucuuaggguuucauuucugugaagagacaccauaaccaaggcaacucuuuuuuuuuuuuuuuuuaaagauuuauuuauuauuuauuuuauauauauaacuauacuguagcugucuucagaugcaccagaaaaggccaucagaucccauuacagaugguugugagccaccaugugguugcugggaauugaacucaggaccucuagaagaguugucagugcucuuaaccacuaagccaucucuccagcccccaaggcaacucuuacaaaggaaaacauuuggggcuggcuaaaaguuucagagguuuaguccauuaucgucacggcaggaagccgagaggcaugugggcaguggugcuagagaaggagcugagaguuguacaucuugauccaagggcagcuaggaagaggcucugauugagccuaggcugguggagccuaggcacgggagaccucaaagcuuacccccacaguuacacacauccucccacaagaccacaccaacuugauuaaggccacaccuccuaauagugccccuuuuuguagggcaagcauucaaacacacgagccugugggggccaaacauacuaccacaauguguauggguauuauagccugccuguguuccugguauccacagaggauggucaccuggaacuggaguuacagacagucaggagcuacuaugaaagugcuaaaaaccgaacccuaagcauucuuagucacugagcugucucuucggccccuuuuccuuucuguauggaaaugggaacugaccacagugcuaaacauagacguguguucucuacuacuuauauauauauauauaccacguggauaccccaagauuuuuuaguauaguuuaguuuguuuguuuuguuuguuuuuguuuuagacauuguuuccuauauaacccaggcuaguuuugaacucacgauguagcccaaaagaccucaaaauugaugugccccccccccccauccuguguguuucuaagauuccaacaaauucuacugcauucugcuuuuccuaaccuccuaauaagaucugccggagccaggcuucuguaggagguuggggugggauaaggcuuugucucaacaaacaaaugacaacaacaaaaaaaauaaacucccgaauuggacuguauuaguaauguacuagaaagagaagaagaagaaagcugccuuugaaaugagaaauaaucuaagacauuguauacagagcaugcuugucagaaagccgagacaaggacagagcgccugugguuaguguggaaccugcugaggggucguggacaaacuaagaauuugaccuccuggaaggugacacgauccuuaaucugugacaccuuuuauguuuucucauagguucacccauugccacuggcacgggcacucuucuccugguccuguuagacgucaaugacaacgcucccaucccagaaccucgaaacaugcaguucugccagaggaacccacagccucauaucaucaccaucuuggauccagaccuuccccccaacacgucccccuuuacugcugagcuaacccauggggccagcgucaacuggaccauugaguauaaugacgcaggugugaaggcucgcugucuuuagagaggcucugccugucccgcuucacccuucccuuugauaucugcccccgguuccuucugcauucaugcacgcuccuuuuccucguauugcgcgguauuccuccagcacucgaugucucugguucccuaaacccuuugauucacugagcuuuuugcucugcccccucucccggucucaucguuccuguuuuccuuucccuagcucaagaaucucucauuuugcaaccaagaaaggacuuagagauuggcgaauacaaaauccaucucaagcucgcggauaaccagaacaaagaccaggugaccacguuggacguccaugugugugacugugaagggacggucaacaacugcaugaaggcgggaaucguggcagcaggauugcaaguuccugccauccucggaauccuuggagggauccucgcccugcugaguaaguucagguggcaggugcuucagcccgugaccucuaaaaccaggaagggccaucuccuaggaggagcuuuuauuugggguacagggggcgcaggauccuucuguucugucugucucugcucgccuagauugagugcauguccuucaguaaguggggcuucagacccaggaucccugaugaggcuccucagaugcuucauuuuaaaccaguccccaaggaaugcugugcuggcagagccagguuuacguauagcucgcuguacucguuagcacaggcaaggcuggcagcuaccaucaccuccgcauuccaucuuggagggcagaugagaggggaaguagaggcugccuaccugcagguuguagaugucagcagcacucacaucucauuggcccaaguguagccaugacaaaugacaaggcauccuggaagcuccugcucuuagcugggugaugaugagcccauuuucauugcaugcuugggagacagugguauuggauggagggcugagugagcagcggauggugcccauggcugaaaagaugaaggagaguggagaugcuuggagggaaucugucauuuuuguccguggucuuuguucugauuuuaccuguccugggcuugguaaaaugccaugaggauuucaaugaucaaagauacgggguuuugcuuauugaggauauaccuugacuuuuuuugucgggggcaguagauaaagcuggggaaauucucuuauuagacauuggaagcagaagugguaucaggagccagaugucaaacuuguuuaucauuuuuguuauauuguuuuuugagaaaugaucucauuuggcuggacaugagauaguccucguucagguggcuacccaccugccugguggggugaggcuguggcauuccaggacaguggcuuccccuggucuuuccugcguguggcucaucacucuucccugccuuccuuccuugucuccaguucugauccugcugcuccuacuguuucuacggaggagaacgguggucaaagagccccugcugccaccagaugaugauacccgggacaauguguauuacuaugaugaagaaggagguggagaagaagaccagguggguuuuaaagauggagagcuuuaagucugauuaagggguguuggguaggcuaugucagucaucacccugcuguacugcuauggaggacagaacucuguggucacaagaauucaaguuucuucccccagacacucuuguguucucuacacugcugguugauuacauugagacucacaacaucuguaaaucagugagggccuuucccaaccaggcagcguugugaugaaagacucuaagcugcagccuacgcucgggucugcugcacgggagccucaugugaguugcaguaggcaugcauugcugucuuauugccugaagccccucacaugccagagcccguuuuuaacagacaagacacuacuuguaucagcugugacggggaggacuaaggauuugccaggugauuaccugauaaucaugucccgagaaacgaguaagacucaauagcuugaguucaugcaguccccaagggcuccuuuuucuuucaguuugcaucaggagacuuguaguuuggaaaaugccauuucauaugcauuugggcacuugggggucguuugcuuuguccaucagcauagucugugaugccaugaagcaagccccgcccugugcgagcagcugcuucuuucucacaggcucucaugcucugcucuucucucuaggacuuugauuugagccagcugcacaggggccuggaugcccgaccggaagugacucgaaaugauguggcucccacccucaugagcgugccccaguaucguccccguccugccaauccugaugaaauuggaaacuucaucgaugaaguaaguagacaaggcugugaggcaaaucacaguacaucucuuaacuccgaaccaagaagaaaagcguucuaaaugaggagaaccuuccagugguugcuguacugugccuauguccccgagacaaaagcaaaaucuacuugcagagauuuaggagaccuaggaguuacagagcaaaucugcuuugcaugaguuuccugcauucauuacaccuguuugggggagugucacagggagccaaaggccgcuuggcagguagauaaaacagcaucucagcuacaugaggaccguaguuggugccucagauacacuguaguuggcauccgaggcaccaacguaaaugccgagcaggcaugguggccuguuuauucuaguguucagauuagagcauccugaaucagcaagcucuagguucuguugucugagaccuugucucaguaaaugagguaaagaaaaguugaggaagaccccugauauugucaaccuuggguuuucauaugcacaugugcacacaaaaacacgcuauacauagcacacacaguguuuuccagauuaccuaaggccccuaaaaauagcaucccucauguaacauacucacguaacguacuuauauguguuagaaauaguuucagcucugaucaaaacacuuaaacagauaauaggagaugcuggguucagcauucuauucuguugaaaacauaugcacauauauaacauauuaacucuucuaccauccugcuccauuauuuugcugucuuagguguguuucuuucuccucuuuucucuucucuucucuucucuucucuucucuucucuucucuucucuucuccucuuuucucuucucuucuccccuccccuccccuccccuccccuccccuccccuccccuccccuccccuccccuccccuccccuccccuccccuccccuccucuccucuccucucuucucuucucuucucuucucuucucuucuuuucuuuucuuuucuuuucuuuucuuuucuuuucuuuucuuuucuuuucuuuucuuuucuuuucuuuuccaagacaggguuucuccauguagccacagcuguccuggaacucucuucauagaccaggcuggcuucaaucucagagccccaccuaccgcugcauucccaagugcugggauuaaaggugugggcugccacugcccgguauugguuacuuuuuuuuuuuucuuuuuugcugugccaagauaccaugccuaaggcaguuuacagaaggaagagucuaauuugggguucuagaagguuagaguccaugacaaucauggcagggagccuggcagcggguagacaugcacagcuggagcaggagcugggggcucaggccagccuggucugcaaagugaguuccagacagccagggcuauacagagaaacccugucucaaaagacaaaaacaaaaaccaaaaaaaacccaaaaaccaaccaaccaaacagaaaaaugucaagccuuggccaugccuuuaguccuugcacuugggcgauaguagguagcagguguaucucugaguuugaagccaaccugaucuacaggagggaguuccaggauguccaggaaaaaccuggauucaaagaaaagcagaaaaagacugaagccuguucucaguagcacaccuucuccaacaaggccacaccuccuaauccuuccaaauuguuccagcuggggaccaagaguucaaacacuggcuggcuuuguauguacucgcuauguagaucaggcuggucuugaaguauguagcagaggaggacuuuaaauuccugauucccccaacuucagaauuaacauuuaacaauagcaguuugucaucuguccuucgaggauuuucugggcugaacuguaaccuacguguuuuaguaugacgacucucguugcucuuacccucuguccagccuggccuugggacuuugccuucugugcugguguguguguguguguguguguguguguguguaccuugaagggguuaacuacuccuugguuaguuuuucauguuugggguguugcuugccucugaugcauacugauaaguacggugcucuuccuuuuagaaccugaaggcagccgacagcgaccccacggcacccccuuacgacucucuguugguguucgauuacgagggcagugguucugaagccgcuagccugagcucacugaacuccucugagucggaucaggaccaggacuacgauuaucugaacgaguggggcaaccgauucaagaagcuggcggacauguacggcgguggugaggacgacuaggggacuagcaagucucccccguguggcaccaugggagaugcagaauaauuauaucaguggucuuucagcuccuucccugaguguguagaagagagacugaucugagaagugugcagauugcauaguggucucacucucccuacuggacugucuguguuaggaugguuuucacugauuguugaaaucuuuuuuuauuuuuuauuuuuacagugcugagauauaaacugugccuuuuuuuguuuguuuguuucuguuuuuguucuuuugagcuaugaucugccccagacacaacagccccaagccccucacaccucacuaauuuuuuacauuguguacuugcccucaauuaccauguuugcuguauucuaauagucacucauguuccugaauucuguugcccugcccaggugauauucuaggaugcagaaaugccugggcccuuuuauggugagagacagguaucuuggugugggugcaacugcgcuggauaguguguguguucccaagaucuuucgugguauucccucuccaccuccagagaacucauuuacaguggcauuccuuguucggcuaugugucuggggcagaacaaaaaaaagggaccacuaugcaugcugcacacgucucagauucuuagguacacaccugauucuuaggugcaugccauagugggauauguugcuuugaucagaaccugcagggagguuuucgggcaccacuuaaguuucuuggcguuucuuucaaaccaaaacuaaagaaugguuguucucugagagagacuggagugccaccaccaaagacagaggagagaaaaggagagaaaccaaacuuggggacagcaacaucagcgaacccggcuaguuggcacaccgauggugaggguacacaggcggugagaccuaucccacaagauuucuggaagacuaggcuuaucucaaccaauguuuucuggcuggaaucuuuguccauguauuccugaagcccaggaaaugcaccccuccaaugccugcucuugaugguagcuacagaaaaugcuggccgauuuaaacccaaguugcccaguucugaguagaaaacugagacuaugcuguguguggcggcgcgcaccuuuaagcccagcacucaggaggcagaggcagucagaucucccugaguucgaggccaaccugguauauauaguauaguaagcgaauucuaggacagccagggcuacacagagaaacccugucucugcaaaccaaaagagaaaacugagaauauuacaaauugugcauuuucucaggaagcaggaagagaacauucuaacgggaaaaaggagacaagaccuuugagaguuuucauucaaaaugcaaaucucagcuuuuugauaaccacuggaaagaauuuuauugaaaguucuguacuuaccuaacuuuggaagaaaaugaugaccacaaucaacugugagaacuguugauuucucuguaguuuaaucauguaauguugcuagagugaccuuuguauguaguuugaguguaugugugugggugcugauaauuuuguauuuugugggggguggaaaagguaagccauugaaaccguucucuaagaugcauuuuuaugaauuuuauuaaagaguuuuguuaaacugu

SEQ ID NO: 12425 - RNA, 66880 nt, Mus musculus
acaguuuaacaaaacucuuuaauaaaauucauaaaaaugcaucuuagagaacgguuucaauggcuuaccuuuuccaccccccacaaaauacaaaauuaucagcacccacacacauacacucaaacuacauacaaaggucacucuagcaacauuacaugauuaaacuacagagaaaucaacaguucucacaguugauuguggucaucauuuucuuccaaaguuagguaaguacagaacuuucaauaaaauucuuuccagugguuaucaaaaagcugagauuugcauuuugaaugaaaacucucaaaggucuugucuccuuuuucccguuagaauguucucuuccugcuuccugagaaaaugcacaauuuguaauauucucaguuuucucuuuugguuugcagagacaggguuucucuguguagcccuggcuguccuagaauucgcuuacuauacuauauauaccagguuggccucgaacucagggagaucugacugccucugccuccugagugcugggcuuaaaggugcgcgccgccacacacagcauagucucaguuuucuacucagaacugggcaacuuggguuuaaaucggccagcauuuucuguagcuaccaucaagagcaggcauuggaggggugcauuuccugggcuucaggaauacauggacaaagauuccagccagaaaacauugguugagauaagccuagucuuccagaaaucuugugggauaggucucaccgccuguguacccucaccaucggugugccaacuagccggguucgcugauguugcuguccccaaguuugguuucucuccuuuucucuccucugucuuuggugguggcacuccagucucucucagagaacaaccauucuuuaguuuugguuugaaagaaacgccaagaaacuuaaguggugcccgaaaaccucccugcagguucugaucaaagcaacauaucccacuauggcaugcaccuaagaaucagguguguaccuaagaaucugagacgugugcagcaugcauaguggucccuuuuuuuuguucugccccagacacauagccgaacaaggaaugccacuguaaaugaguucucuggagguggagagggaauaccacgaaagaucuugggaacacacacacuauccagcgcaguugcacccacaccaagauaccugucucucaccauaaaagggcccaggcauuucugcauccuagaauaucaccugggcagggcaacagaauucaggaacaugagugacuauuagaauacagcaaacaugguaauugagggcaaguacacaauguaaaaaauuagugaggugugaggggcuuggggcuguugugucuggggcagaucauagcucaaaagaacaaaaacagaaacaaacaaacaaaaaaaggcacaguuuauaucucagcacuguaaaaauaaaaaauaaaaaaagauuucaacaaucagugaaaaccauccuaacacagacaguccaguagggagagugagaccacuaugcaaucugcacacuucucagaucagucucucuucuacacacucagggaaggagcugaaagaccacugauauaauuauucugcaucucccauggugccacacgggggagacuugcuaguccccuagucguccucaccaccgccguacauguccgccagcuucuugaaucgguugccccacucguucagauaaucguaguccugguccugauccgacucagaggaguucagugagcucaggcuagcggcuucagaaccacugcccucguaaucgaacaccaacagagagucguaagggggugccguggggucgcugucggcugccuucagguucuaaaaggaagagcaccguacuuaucaguaugcaucagaggcaagcaacaccccaaacaugaaaaacuaaccaaggaguaguuaaccccuucaagguacacacacacacacacacacacacacacacaccagcacagaaggcaaagucccaaggccaggcuggacagaggguaagagcaacgagagucgucauacuaaaacacguagguuacaguucagcccagaaaauccucgaaggacagaugacaaacugcuauuguuaaauguuaauucugaaguugggggaaucaggaauuuaaaguccuccucugcuacauacuucaagaccagccugaucuacauagcgaguacauacaaagccagccaguguuugaacucuugguccccagcuggaacaauuuggaaggauuaggagguguggccuuguuggagaaggugugcuacugagaacaggcuucagucuuuuucugcuuuucuuugaauccagguuuuuccuggacauccuggaacucccuccuguagaucagguuggcuucaaacucagagauacaccugcuaccuacuaucgcccaagugcaaggacuaaaggcauggccaaggcuugacauuuuucuguuugguugguugguuuuuggguuuuuuuugguuuuuguuuuugucuuuugagacaggguuucucuguauagcccuggcugucuggaacucacuuugcagaccaggcuggccugagcccccagcuccugcuccagcugugcaugucuacccgcugccaggcucccugccaugauugucauggacucuaaccuucuagaaccccaaauuagacucuuccuucuguaaacugccuuaggcaugguaucuuggcacagcaaaaaagaaaaaaaaaaaaguaaccaauaccgggcaguggcagcccacaccuuuaaucccagcacuugggaaugcagcgguagguggggcucugagauugaagccagccuggucuaugaagagaguuccaggacagcuguggcuacauggagaaacccugucuuggaaaagaaaagaaaagaaaagaaaagaaaagaaaagaaaagaaaagaaaagaaaagaaaagaaaagaaaagaagagaagagaagagaagagaagagaagagaggagaggagaggaggggaggggaggggaggggaggggaggggaggggaggggaggggaggggaggggaggggaggggaggggaggggaggggagaagagaagagaaaagaggagaagagaagagaagagaagagaagagaagagaagagaagagaagagaaaagaggagaaagaaacacaccuaagacagcaaaauaauggagcaggaugguagaagaguuaauauguuauauaugugcauauguuuucaacagaauagaaugcugaacccagcaucuccuauuaucuguuuaaguguuuugaucagagcugaaacuauuucuaacacauauaaguacguuacgugaguauguuacaugagggaugcuauuuuuaggggccuuagguaaucuggaaaacacugugugugcuauguauagcguguuuuugugugcacaugugcauaugaaaacccaagguugacaauaucaggggucuuccucaacuuuucuuuaccucauuuacugagacaaggucucagacaacagaaccuagagcuugcugauucaggaugcucuaaucugaacacuagaauaaacaggccaccaugccugcucggcauuuacguuggugccucggaugccaacuacaguguaucugaggcaccaacuacgguccucauguagcugagaugcuguuuuaucuaccugccaagcggccuuuggcucccugugacacucccccaaacagguguaaugaaugcaggaaacucaugcaaagcagauuugcucuguaacuccuaggucuccuaaaucucugcaaguagauuuugcuuuugucucggggacauaggcacaguacagcaaccacuggaagguucuccucauuuagaacgcuuuucuucuugguucggaguuaagagauguacugugauuugccucacagccuugucuacuuacuucaucgaugaaguuuccaauuucaucaggauuggcaggacggggacgauacuggggcacgcucaugagggugggagccacaucauuucgagucacuuccggucgggcauccaggccccugugcagcuggcucaaaucaaaguccuagagagaagagcagagcaugagagccugugagaaagaagcagcugcucgcacagggcggggcuugcuucauggcaucacagacuaugcugauggacaaagcaaacgacccccaagugcccaaaugcauaugaaauggcauuuuccaaacuacaagucuccugaugcaaacugaaagaaaaaggagcccuuggggacugcaugaacucaagcuauugagucuuacucguuucucgggacaugauuaucagguaaucaccuggcaaauccuuaguccuccccgucacagcugauacaaguagugucuugucuguuaaaaacgggcucuggcaugugaggggcuucaggcaauaagacagcaaugcaugccuacugcaacucacaugaggcucccgugcagcagacccgagcguaggcugcagcuuagagucuuucaucacaacgcugccugguugggaaaggcccucacugauuuacagauguugugagucucaauguaaucaaccagcaguguagagaacacaagagugucugggggaagaaacuugaauucuugugaccacagaguucuguccuccauagcaguacagcagggugaugacugacauagccuacccaacaccccuuaaucagacuuaaagcucuccaucuuuaaaacccaccuggucuucuucuccaccuccuucuucaucauaguaauacacauugucccggguaucaucaucugguggcagcaggggcucuuugaccaccguucuccuccguagaaacaguaggagcagcaggaucagaacuggagacaaggaaggaaggcagggaagagugaugagccacacgcaggaaagaccaggggaagccacuguccuggaaugccacagccucaccccaccaggcagguggguagccaccugaacgaggacuaucucauguccagccaaaugagaucauuucucaaaaaacaauauaacaaaaaugauaaacaaguuugacaucuggcuccugauaccacuucugcuuccaaugucuaauaagagaauuuccccagcuuuaucuacugcccccgacaaaaaaagucaagguauauccucaauaagcaaaaccccguaucuuugaucauugaaauccucauggcauuuuaccaagcccaggacagguaaaaucagaacaaagaccacggacaaaaaugacagauucccuccaagcaucuccacucuccuucaucuuuucagccaugggcaccauccgcugcucacucagcccuccauccaauaccacugucucccaagcaugcaaugaaaaugggcucaucaucacccagcuaagagcaggagcuuccaggaugccuugucauuugucauggcuacacuugggccaaugagaugugagugcugcugacaucuacaaccugcagguaggcagccucuacuuccccucucaucugcccuccaagauggaaugcggaggugaugguagcugccagccuugccugugcuaacgaguacagcgagcuauacguaaaccuggcucugccagcacagcauuccuuggggacugguuuaaaaugaagcaucugaggagccucaucagggauccugggucugaagccccacuuacugaaggacaugcacucaaucuaggcgagcagagacagacagaacagaaggauccugcgcccccuguaccccaaauaaaagcuccuccuaggagauggcccuuccugguuuuagaggucacgggcugaagcaccugccaccugaacuuacucagcagggcgaggaucccuccaaggauuccgaggauggcaggaacuugcaauccugcugccacgauucccgccuucaugcaguuguugaccgucccuucacagucacacacauggacguccaacguggucaccuggucuuuguucugguuauccgcgagcuugagauggauuuuguauucgccaaucucuaaguccuuucuugguugcaaaaugagagauucuugagcuagggaaaggaaaacaggaacgaugagaccgggagagggggcagagcaaaaagcucagugaaucaaaggguuuagggaaccagagacaucgagugcuggaggaauaccgcgcaauacgaggaaaaggagcgugcaugaaugcagaaggaaccgggggcagauaucaaagggaagggugaagcgggacaggcagagccucucuaaagacagcgagccuucacaccugcgucauuauacucaaugguccaguugacgcuggccccauggguuagcucagcaguaaagggggacguguuggggggaaggucuggauccaagauggugaugauaugaggcuguggguuccucuggcagaacugcauguuucgagguucugggaugggagcguugucauugacgucuaacaggaccaggagaagagugcccgugccaguggcaaugggugaaccuaugagaaaacauaaaaggugucacagauuaaggaucgugucaccuuccaggaggucaaauucuuaguuuguccacgaccccucagcagguuccacacuaaccacaggcgcucuguccuugucucggcuuucugacaagcaugcucuguauacaaugucuuagauuauuucucauuucaaaggcagcuuucuucuucuucucuuucuaguacauuacuaauacaguccaauucgggaguuuauuuuuuuuguuguugucauuuguuuguugagacaaagccuuaucccaccccaaccuccuacagaagccuggcuccggcagaucuuauuaggagguuaggaaaagcagaaugcaguagaauuuguuggaaucuuagaaacacacaggauggggggggggggcacaucaauuuugaggucuuuugggcuacaucgugaguucaaaacuagccuggguuauauaggaaacaaugucuaaaacaaaaacaaacaaaacaaacaaacuaaacuauacuaaaaaaucuugggguauccacgugguauauauauauauauaaguaguagagaacacacgucuauguuuagcacuguggucaguucccauuuccauacagaaaggaaaaggggccgaagagacagcucagugacuaagaaugcuuaggguucgguuuuuagcacuuucauaguagcuccugacugucuguaacuccaguuccaggugaccauccucuguggauaccaggaacacaggcaggcuauaauacccauacacauugugguaguauguuuggcccccacaggcucguguguuugaaugcuugcccuacaaaaaggggcacuauuaggagguguggccuuaaucaaguugguguggucuugugggaggauguguguaacuguggggguaagcuuugaggucucccgugccuaggcuccaccagccuaggcucaaucagagccucuuccuagcugcccuuggaucaagauguacaacucucagcuccuucucuagcaccacugcccacaugccucucggcuuccugccgugacgauaauggacuaaaccucugaaacuuuuagccagccccaaauguuuuccuuuguaagaguugccuugggggcuggagagauggcuuagugguuaagagcacugacaacucuucuagagguccugaguucaauucccagcaaccacaugguggcucacaaccaucuguaaugggaucugauggccuuuucuggugcaucugaagacagcuacaguauaguuauauauauaaaauaaauaauaaauaaaucuuuaaaaaaaaaaaaaaaaagaguugccuugguuauggugucucuucacagaaaugaaacccuaagaaacacauaaaauucaaaauaaaagagagaaaaguugaagauuauaagauuauaaauugaagaauuauaagauuuaaguaauaguaaguucauaaccaugaaccaaguuccugcaggaaggagugagauucaagugcagaaagggagaagagggaaagaaagucuacuugaucuaaaguuuggaauucaguuaccaaaaguuuuauguuaugauugauuguuuguuuguuacagauaaaagaaagaaugaagucuccuccuccuaguaaggcagaggcagagggggcaagcaagcuggagaaggauggagcccaggccacaauggggaugggaccacacgguguccauaccaucaucuguggcgaugaugagagcuacauaugugcuguucuucacaugcucagcgucuucucuguccaucucagcgcgcgugaaaauggcaccagucucuggguuaaucuccagccaguuggcagugucccuccaaauccgauaccugagggcacaagcucugggugagaauaggaacagcaaaggaacugaagaaggucacagguccucuucacuuguuacacaguugccccuuuuaaauacauauacgcauauauauuauaaacacuaauuuuaccuaugugcgugugccugaguguauauaugugucccacauagugcaagagguuagaagagguaucagauccccaggaacuagaguuacauaugcuuaugagcuuccauguugaugcggaccccaguccuuuaguaaaaaagguggggcgugugauacccugggaccuccaccaaauggcaauucuucagugaaaccccagcccccuugccauggacacauaaaucagaaugucuuaucauuacaugacaaauggcuauauauuuuucuuuaauuuaagacuuauuuauuuauuauauguaaguacacuguagcugucuucagacacaccagaagagggcaucagauuucauuacggaugguugugagccacuaugggguugcugggauuugaacucaggaucuuugggagagcagucggcgcucuuaacugcugagccaucucgccagccccaaauggcuauauuuauaguuacauaaaugaauauauaaauuauguauuaaaaagccaaaguggucagccauggugacacaugccuuuacuuuagucccagaacuagggagguagaaggagcucuaugaguuugaggccaaucuggucuacaaagcaaguuccaggacagugaggacuacggugagacccugucucaaaaaagaagugugacuacaaaccaacacccauucaagagucgccacugaaagggauccuacucacgugaucuucugauccaugaacguguccggcucucgagcgguauaagaugugauuuccugacccacaccaaagucuucgggcacuucgacucuccucuccgcaggcauaaagaugggggcuucauucacgucuaccacguccacagugacaguggcuguggaagggacaagagaccccucaaaggguuccucguucuccacucucacaugaaggauguauugcugcuuggccucaaaauccaagcccuagagaacaggagaaagacaaagucaaaacuaaaauaccacaggaucagauguguggcucggugguagagcacccgcccagcaugcuuaagguccuguguuccaccaccacugccacugaacaaauauauaagcuuuaaaaacugguuaguccaaaaaaauuuuuuuugagggguuuaguuucagcuauaaucuuuaggguuuuuuguuguauuuuuccucccgagacaggguuucucuggagcccuagcaacccggaacucacacuguagacuaggcuggucuugaacucacagagacccacaugccucugccucccaaguacugagauuaaagccagcaccaccaccagcuggcucagauaccauuuuuugguagacaguaguucucaaacauggcuucucacuugcugaagagggcacuaaagcucuauagacacucuaggcaucuacuaacuaacguuugcuaaauuuaccaguaagucuuccccacuuuuaauuuggacauauuccaaagauuuaccagcaguugugaccugccauguaaauccucuacagagcaacaagugcucuuaaccacggagccaucaucuuuccagcccagugguucucaacuuuccuaaugcugcgagcuuuuaauauaguuccucauguugugaugaccccaaccauaaaauuauuuucauugcuacuucauaacuguaauuuggcuacuguuaugaauaauaauguaaauauguuuucagguggucuuagcaacccccccuaccccaaaaggggucaugacccacaggcucugcugccuagccucaggcuuuagaauauuuuucgaaggagccauaccaaucucacuucuaaugacccagcaaaacagccaugagaguuucugcaagccccagcacgucaguaccacccucagacuuccaaccucucccccugccaguguugaaccacccacgagaagacaucgugggacgagagacccucagccaguggcacaucauucacuaagcaccguacaaaccuuggcuguuuucaaaaugccaucauuggucguggggucugugacaacaacgaacugcuggucaggaucguugacuacgguguacacagcuuuccacgccggaguguugggggcaucaucaucggucacuuugaguguggcgauccgggcauugaccucauucucaggcacuugacccugauacugaagaggaaaggaaaaauugggucauuagugacaagaugacaguaagcauagacccagggcuugggcuaaaggaaugggaaccauacugaggccaauucuggagacauaggugggaugagugaggucaagaaacucgcaugagucucuaaggauggagguaagagcccugggaacaggccaucaguucccaucaguagaucaacuagcagcuccgagcacccuccucuauacacgcugaaguagcuuucugaggcccuggguacaaggacccucuguuagucccauugucugcuuacuuugaucuuaagacagguguacuauuugcucccacacccaucuucucucuagucucuauuaguagacacuaaauaagauaaaucaguugucccuggggccuauuguaacaaaagggaaagagaaaaaaaaaaaaaaaaaaaaaaaaaucaacccugccuuuugaaucuacacuauuugggccucugcuaacuaagcaaccaccauaucaacuucuaacucacucaguaacauauggucuucucuucuaaggcuaaaaagauggccauggcauuauaaaccugccugccaacgugggcuauaaaauuuuaauuugauuaaguucugugugcauguaugugugugcaagcguacucgagucugcagacgaaguuccuuuaucuggcucuuaaaaccuuuuccuugaauguuuuugacauucauucauucauucauucauuugauauuuggcauuuagugauucuuaacaaagcuggacauggcaucuuacagcuguaacccagcauuuaggaggugcguuguugagcuggaggccaggauggguuacacaguaagaucuggcucaaaucauccauccuccuaaaauuauauauuuccuauaaauuguaaguuccacagacuagaaaacuugucugcuuugagcuggcaggucuccgguaacacaggguggaauauaaacuuaggaaauguuaggaguaagugagacccacagauacuauagauaugcugagguaaggacagcaaggacucaggagcuuucggcaauacacgaucacgugccaauggccccaggcaaaagauagaagaagcauuucaaagauuguagcugcucuaggauguugguuucuaagucugaagcucacauucacuaaccuagggaagaguuuuuaaaggguucaccagggcacaggggcaaaacuuagcucgugagcaaugaagggcccuucauggaacaaagaagguggagaguuaccgugcuuggguugaagacaggagcguugucauuaauauccuugacagugaucacagccuuggcuguugugcucaagccuucaccuugaaggucagcagccugaaccaccagaguguauguaggguaacucuguagacaccaaaacacauggaaucagaacccacuccccaucagucaccccaaacccagugcagcuuacugcguauagaaaaguauuugaccacgugcuuaacugcccaggcugccuguccccaggcacagagcuucugcacagguauuuagauauaaagccaagccacuuacacuaacugaccacuaggcuuagcagaggguuacacuguccaugggauuuaauguauauuugcccuucaagccccucugccaucccccgaguucugccugaccucucgguccagcccagaggugagcacacugaugaccccggugucccuauugacagugaacauguuuuugugaggcagcucaggauccuggcugacgaugguguaggcgauggcagcguuguagguguugacgucaucgucugcaucgguggcugagaccuucaucacggagguuccugucaaaggagaggggccuuaaauggguugcaauggcuacccugggauuugcucacaacuauucagaacaauccuguuccagaagauaagcacacuuugucacaguuuuuauuucuaaaauucucagcaagcuaccagucaagggggcaucacaccaaacgagccauggucagggaacucaacuuuuaaugccuacaauucagaugugaggaggaaaggaagaugguguuggcaauaaauaaauaucgcuaccaaguccuucccguucuuauuuuauuucuuuucauauuucuucuuauuauuuuccuccuccuccuccuucuauuauuauuauuauuauuauuauuaguaguaguaguaguaguauguacacuuguagauaguaguaguaguaguaguaguaguaguagaugcccuuaaaggccagaagagggcaucacaucccuuaguaguaguaguaguaguaguaguaguaguauguacacuuguagauaguaguaguaguaguaguaguaguaguagaugcccuuaaaggccagaagagggcaucacaucccuuagagcuggaguuauauacaugcaccaccaagcucauauauguuucuacagguagaauuuuauauuugcucccucaugccuccaccucaucccucaggguggcuuucaaagagcaggucggaacuucagugacacgaucucuaaucccauccuucaaggucuaaagaacccaaaugucuuucuggguacucaguuccuugagacuaauuuaccuggaacagcgccuucugcaacgaaucccucaaagaccggcuggguaaacucuggccuguugucauucugaucugucacugugaucacuaucuccaugggauccuccaccgcuuccccauuugaugacacggcaugagaauagagcugcaagagagucaagugaggguuacuuggaagaagauccaggguggcgagucuggcuagaauggcuccaucuagccuccacucuuucuacuaugacaccuucaugugagaauuuuccacauuguguguugcugcuuaaugaacucaugaugaagucucaaagcuagagacaaccaccagccagccagcccauuuaucacauaauacacaaauuucaguuggggucauuuucccucuggcuauuucagucuaauauuuuccugagauuuuucuauauuuggcaccuacagauuaucucccuccucccuaaguucacauugcaaccaagucucagaagugagcuuugcucccuauaguuauuaucagaacaaguaucaucuagguaagaaauuucuccccaagaacaaguugacauuuaaaaaaaauuauauauauauauauauauauauauauauauauauauauauauauauauggcuggagagguggcucagagguuacuaccauugccugcucuucuacagguccuuuguucuauuccuagcauccacauggugacucauaaccaccaugaccucugaugaucucuacugguguagagucauacaugcaggcaggaugccaauuuaaaaagauauauuuauuuauuuuuuauuuuuuuuaugugcacugcuguuuugucuacaucaugucugaguaagaguguugaauccuuaggaacuggaguuacagacaguucugagcugccaugugggcuacaaauuaaaccaggguccuuugaaggaguagcuagugcucuuaacugcuaagccaucucucuagugcccaaccuuucucccuuuuuuauguauauaaguguuuuggcuccagguagguauguguaccauaugugagcugguacccauggaggacacugaguuccuuggaaccugaguuacaaaugauuauaagcuaccuugucaguauggaaaaccacacucagguccuuuacaagaacaaccagugcucuuaacaacuaagccaucucccgagccaagacaacaucuuucacuuuauguguauguauguguauaagucagaagucaucuaggaaaggcuaaggcauacaaguaagcuuucuggagauggcccacccuucugaauaaguacaaugggugagcucugagaacacaggguccuuagaggcuucaucccaggauuguaucuuguugcugauaugccuuuccugucacuauuacauagccuaaugaucccugggcaucagcccacccaauugggcacauuuccugccgaaucaauaugaagaugugcuuucauacaguaaugcuguguagaagaauuaaugauuacauaaauacugauaaugaugaauuuagaauuccuaaauugauacaaguaaucucaaguccccuguagaagaaaaagcugcaaacagagcccuguaaugcuucaugugucacaggcuaauugcacuaggaaaagaaagcaggcuuggaacaaauuuaugaccaaggaaaacauuccuucugguuaggaacaaggucacuaucugguaacgaaaggucauaaacugggaauggauaauuuauuguaggugcaaagacaacaaauaaaauauugacuaguuuaucuauauaaaacuuuaaaauuaauaagacaaaagguaggugauuuaucuccacaaaaccgugcuaauuugugauaaaaaauuauuuacuuauauugaacuuauagagcuaaagauagauagcagauguuuagucagauacuaucuuaaugggaagagauuaaacauuucugcucuaacuccuuaaaccuuaugacaugaacugcugcuuuuacuaugaacuuacagaauggaaaaguguuuagaaaaucauguaagccuagcagcaguggcacacgccuuuaauccuaacacuugggaggcagaggcagguggaucucugaguucgaggucagccugaucuacagagugaguuccaggacagccagggcuacacagagaaacccugucuugaaaaaccaaaaaagaaaaaagaaaaaaagaaaaaaaaaaaucauguaaucaauucuaccugauagcuguaugagguaauuuucagagaauguguguauacugagaacagaaauaaagauuuguuggagauucuuuucucugcuucauccagagugaguagagucuuuuccuuucucucuggcccacaaagaguuaacagaacucucagccucagagucaaaaaggagacagccuaagcaacuaacuucuuuucuuaauccccugcugcuaucagcaggaguuaauugccagaaaucaucagcuuuuagccacagaauagugagagaguuaaauugccagacagcuucugacccccaaaacagcaaggaagaguucugaagcuaucaccagccuuuagcuuuauccaaggcucccccaccuccauaccuguuagagcaggcuaguccccagcauguauauguauguaugucucugucucuaucucuaucccugucucugccugucucugccucuguguguguucgcauacacuuuugugcaguuaucaagggaggucauacggugucagaacacccagagcugcaguuucaggugguugugagcuacccaugugaaugcugggaacucaacucaagauucucuucaagggcaacaaauguucuuauccacugagccauuccuccaggcccacuccuacagcuuccaucuaagcucauguaugaugugaggaaucccuacaacaucaacaacucaccaucccaacuuuaagauaaguuaagcuacuuauauguccagggcauccaaacuggggauaaaacaccagcugcucccaaaauuugacaaccguuacccaguggccaacaagugucuacaaaauuacucacgauguacuuggcaauggcuucucuauccagaggcugugucacuuucagccagccugucucccucucaaugaugaaaacgccaacgggggguuugucagcuccuuggccggugaugcuguagaaaaccuuuguuucuuugucccuguuggauuugaucugaacacaaaacagaagaggaucagaacuggccagggaagaucucaacauggggucuuuucauuuucucuucucucaagagggcagagccugccaccaacuuccucuccuaccugaaccagguucuuuggaaauucgcccuuuucauuuucggggcagcugaugggagggaugacccagucucguuucugucuucugagaccuggguacacgcugggaaacaugagcagcucuggguuggauucagaggcaggguccuaagagaaaagaagauuaacaaaaugagguaaugcagaagacauacgggucuaacaguucauccaucccauggacguccaccaucuugaauuuagugacucauucucaaugacaaauuaccuguaccauucaagaugaacaguuaaaguuuaagccaaagaaauaaacauacuguugucuggacgcugacuucccacaguuccuaugccuaaaagcuugguucccuaacuuaguggcuaaugagaggccuucagaucacagaagauauucagacccgagucucaucuuugcuuucuggaucauaugacaagugguuuacucuccaguacgcuagcccaauuagaggacagaauaaaguaucauaugggcuugaaccuccagaguuaaaaacccaagcaaaccccaccaccaccacccguguuaguauguuuuuuuguuguuguuuguugguugguugguugguugguuugagauaggauuucucuguguagcccuuugcuguccuggaacuuguuuugcagaccaggccggccuugaacucaagagaaauccaccugcaucugccuuccaagugcuggaauugaaggcaugugccaucaccaccagguuguucucauuaaauccuuaauguuuagcauucaaauaaucacugugcauacaaaauuuguggguccagacauuugacaauuguauuuaaaaguuauuucaaacuuauaugguacaugcccuuuaagccauacacugauaaugucagaaguaauucaguaacuagcuauuugggaguucuaggcuucucuucuuuuguuucccuagggauacagcucaccaaaguggagcuaucaaucaacgaguuuggggaauugcuauuaagaacuauuucugaggggcuggagagauggcucagugguuaagagcaccaacugcucuuccaaagguccugaguucaaaucccagcaaccacaugguggcucacaaccauccguaaugagaucugacgcccucuucuggugcaucugaagacagcuacaguguacuuagauauaauaauaaauaaaucuaaaaaaaaaaaaaaaaaaaaaagaacuauuucugagaucgauacaaacauguuaaucuuauuguguuauaucuguaaggguugcauuuguucuaacagaagcagcugggcuaggaaacaaaaauuaccuggagacuugcauugaacaguucucaugugcaauaaagauaacuuccugcacacucagggaaacaggaaagccuaagaugaaaggcgacaccuccuggauugguuuagaaugauuccugguaacaaaguuucuacaagaucucauccuuacccuccacaggaagacacuacaucaacagagaccacagccugccaaguucuagccaggcccucuuuccugucugucuguuguuugguuggaacauuuuuagaaacaaucucaugaagcccagucuggcuucaaauuaugcgggccaucggugaucuugaacuucagguccuccugccuccacucaacaaaggauggaugaugggugcauuuaugugauaguaggguauagaaaccagggccucauguacucuaaaucagaacucaucaacugagcuacauuuucagcccuucuggauugguccccccugcccccaagaaucaaaacaggaaagaccgacagacauaaaaugugaccaaguauucuagaacucagucucacauaccugucacacacacacagucuuaccaucccugcaucuguuacccacagaaaaaagccagcaugggcuaaaggcuggcucugggacuggcuaccuggcuaccagaauagcucccccucggucuccagaggaucacauaccuucugugagaacugucccaauaucuaaaguggggauuuguuuuguuuuguugagauagggcuucacagcauaauccuggcuggccugaaacuuacuauguaaaccagcacucgggaggcagagacaagcagauuucugaguucagugacagccuggucuaaacugugaguuccaggccagccagggcuacauaugagaaauccugucuugaaaaacaaaaaccaacgaaacaaacagaagaggugugcaccaccacaccuggcuuggggguuuccaaaaugcagacuugaaucaaaucaugauauggcagaaauggagaaugaagucagcggaggggaggaugagggugaggggaccagggcaaagacaaccuccaaacuguuguuggucuuagaaagcucccacagucaacugccugguggggacuuacugugcugaacaugcaugcaugcuugacugccagcaagcuggggcuugggucucaggaagccaugacuaacauaacagaacuaaguucuucacuucucuaauuccggagaggaaaacuacauccgggauuauuaaaucucaggagucucaagugucuucagagaacagaacagaaaucaacuuuaaaggcuuuggcacaauccacaccccgggagcagaaaucaaagcgugucuagaauguccccuagagagacaccauaggaagugcccagagaccauucucaaaauggacagaagcauuuauguggcuuuuggugacauccuccagggacauucccaagcagagucuagaccacacacaagcuguguaucugccucuucacuguacggguuuucgggacugcgcaggaccuaagagcagcacugcaaacaucaggagaaggaucuuacauaacgacagugcaaagaagacuuaaaacaaacaagcaaucuguuuaucaucucuguguauguuugcaugaauugaaggcaccauucauguguaagcacugcagaggcccgaaagggagccugugucuccuacagcugaguccuggcuguucuaugguaccuaauggagguuuggggagccaaaccuacagcugucucuucagcucuaaaaagggacaaagacuuacuggucuuccuucccccuccuugcuaaauaagacacucauucucucuccaggaaggcaaggccaacagagaguauuugauaagacucuaaccuuccacucagcccucccuccauagcuuagguucacauagguagucaaccaagagcagauagaaaugauuucuuuucaaagccaaauaugguaguacaugccuguaaucccaaacuuuggaggauugggaguucaaggucauccugggcuauagaucaaguuuggggacaaucuuggcuacacaaaaccauccuuuaaauaaaacaaaaagggggacagaaaggauucuacaagauuuuuuuuaagguaucuagaguaggggguguagcucaguuggcagaguacuaagucuagcaugcaugaacccauguauuuaaucccuagagccccacaaacccaggugugauggcacaagcuuacaacccuaucacuccggaaaugaaaaauuagaaguuaucuucugcaguacagugagcugggcaccaucguggcuauaagaaauccuguccaaaaaagagaaaaacgaggaagaaccaacccuguaugaaaccuauuaguacacacccacagucccagaucaagagucuaugaguuugaagccaaccugggcucaaaccaaaauaacuaugagaacaacucuguccgcgcagaacauaugcagacuuacuaauaagggugcaacagugacugucgcauagagucaugaguugagcauuaucuuauguagaggugcauucgcagcaggacaugcuggcuauaggcaaauauccucaccccuauugagcauuuagguuuucauauucauaaaggaagaagaugguccuuguggauaccaaguguauguacaugaucucggugucuccuguguguaaauucacucagucugcacaggggaaacgaccccucuggugucacugggguuguugucagagagaaagcaacugugggcuaacaauccaggcagggccaguaucuuccucaucaccccauacuaccagagccacagaacccaacagcaaaccccaagcccaauaggaauggauucagucagaacgaaagacuguccucaaugggggguauuuuugccacucccacccuaagagucaugaguuuauggagguucuucugcagguauuccaggcaucagggaugccacguagcauccuagagucuucccauaaaauuaucucgcccaacaaguccccagugcuaagacuagaggccccccagauuagacagcucccugaaaaauauacacauaucuaagaaauacccccaaguacguacgcggugguggugccggugaugguggugccccauggacuucagcgucacuuugguagacagcucccuaugacuggagucccgggcgcggacgaggaaacuggucuccagcuuguggagcuuuagaugccgcuucacugugauggugccgucugucgccacuuugaaucgggagucuuccgaaaagaaggcuguccuuggccggccagugcauccuucaaaucucacuacaggauggagaucacagagauuaggaaaguggacagaucacagacaggacauuucuucuccagaaagggaaccugauucaucuagcacaucauacaaaauauacacuaacucaacaaacuggcaaugaacaacccuacccggagagccuuggccucaucguuaaauucuucccaaauacagggcaacugacauuuggagucugggugguuuuuuguuuguuugauugguuggcugguuuucuucacuuagucgucaaugaguaucuugucuauaaagcaaaucuuucauuuucagagugaaagcaaaagagauacuuaauaugaaaccagaccgggaaaugucucaucgggucagagugcuugcagcgcggcauggugaccaaaguucggaccccugaacucagguagagcaagaugugguaaugugccucuauaagccuggcgcuccugcagcaagaugggagauucacccagaagcucaugggccagcuagcucaguguaugcagccaagucugcagagacaagagacccugccucaaagcaagacggaacagaagagucccaaaguuggccucugaccuuuauaccccuccauggcacaucuguaccugcacuuaugcaaacaucagacccacccacacacauacaccacacacaaacaaaacagguaugggggcaaggaacacugguuacauuuccagagguaagcaaaucugaggcuguaggaaacccugccuuauaaacccaaggcaccuagauggcucagcaggcaagcaugcuuacagccaauccugaguuccacuccuggaaccccacagugaaagaacucacucaaaugauaagagaacuaacuguguauagggggguugggaagugggguuucaagacugggcucuguguagcccugaccauccuggaacucacucuauagaccagacuggccuugaacucagagauccuccugccucugccucugccucaagugcuaggauuaaagguguguacuagcacuacccagcuaagagaacugacuugugagcuauccucagacuuccucaggcauaccauaugggacguucugugcucaugggcauaagggguguguguguguguguguguguguguguguauguauguguguguguauacacaaagagaaguguaauagaaaaaaaucucagagggcacauuugaaugaauucacaacaaaucucagaaguuagcuuacuuuccaaacuuucaaacaauugcccaucacuccccacaacggaacuucuacuuugccuaagcauucucuuaugaaaaucccuacuccccugccucuuacauucagguggacggaacacuuucugccccaggaggagaugccugugcuacagugcucauuucuuccaccaggggucacccuuguaaacaucucagaagccaaaagccccuguacuugacagagaaaauagauaugaauguuguuucagugagcaagaagagggagggugcaggcaccaccagucugacuggcaaaaauacacacuuuggagcaaaaggcaaaugagagauaacagucacaggaggaucugucuaaacuugaagcaacuauccuuucuuaugggaagaauggauauguaggaaaagagagagagacugagucugucugucugucugugcagucgaugcuauccaccuuguuuuguaagacuagagucucucauuggccuggaacucaacaaguaagacaggcuggcuagccagcaagcaccaggacuccaucugguaucugcccgugcauacugagauuacaaguccuacacugagaguggcagacuuucuucagggcauagcaagcaccuuacaggcucagccgucuccccuaguucccaguuagcacuuuuaaaguccagauuaggaacauuuaaaggugcucuuaaagaaacccucucaaccugcagcacagguacuggggugagggggaggggcaucugagucaucuuugggggccugucacauaagcagggaacaggagcuggccuugauuccuuucuccagcccgcacaaaucuagccagugaaaaaccaacaggaacaugacuggaccugccaagggugguagcaaaagagagcugagaggcuugguaaauaaccuggugcgaggcaauuaaccugcucaaggcaccucuuaauggcgacucggccucacccuuggagaagugacaccuuguaaguaugacaagagaggcccgaccugaauuuccaggugcugguuaaggcucauuaucuuucuguaaaaccagauccucugggcugagaaauaagggaaaguuggaggggcuugcuggcuccaggaagguucuagaaguugucuuccaccgggcucagcuaugcagaacucugagaacaccaagaucagcccaaggagcugggugugcauugauguuuccccaggggaagguacugaauaaagaaagcugccaagggacuaagucaaccucacccagugggacaccuuuccuuaaccagcugugcuaugcacugguccccaugggaauuaagaccccugagcaucugucucuuaauuggaaaaccuaccacaguagucaccaccaucaccauuauuaccaggaaacuccacaaccucaaacugggugugguagugcacaccugcaaucccaugauuggaaagucugaacuaauacuuucaauuacucuugucaacuacuuuggccacauuuuaaauauuugcagaacacuaucguuccaggcuccauuuuaagcacuuuacaaacauuaaaccguucaaacccagaacuuuauacaguugauauaugcuuugcuuucuauaucuugcuuuuucagacugggucucuucucuguacguagcccuggcuguccuggaacucacucuguagaccaggcuagucucgaacucacagagaucugccugccucugccuucugagugcugggauuaaaggcgugcgccaccacgccucuggcacauccucuuuuuacagaugcggaaaucggcaaggcugggauuuagacgaaggcaaucugagaucucuugcuccuugauugcauuccuugccucucuauagaggguccuugcucuggugguggucuuugccuuguauuuccuuaggcuuuuauuuuuguauguaugggucugucucucucucucucucucucucucucuguguguguguguguguguguguguguguguaggucagaugaugacaacuugcaggcaucaagucucuccuuccauguaggucccugggaucaaacucaggcugccaggcugggcggcaagcauuuuuacccacuuaauucuuuucauccucuagccccuuacuauauaugugcacagggguguauguggcaggggauauaugggggucagaggacaaccucaugggguuagcuuuaugcuccugcuguuacauauaucccauggacugauaugccacugagcuacuggggagggguggugcaacuucucccugcccccaucccagccuugcugaggccccuucagcaugggcuuucuuuuccugaaauuauacacugcugaguucagagcuuaauugguucaccccuaaaugagggcucuucacugcuauucaagacugucccugccccaccccaauuguuggcaaugcaaucgaaaacuuugcauacacagacuagcccgugcuaguaccucuaucaugggcaugaaugauaacuggagaaaacugauagaagagggguugaggugggcuuuuuucccccuaaauacagcucuguaguaaagcauuugccuauaacacguguaaaguuuugaguuaaauuaccaauagggggcaggggagggcuggucucaauccuagcacuugaaaguggaaagaggaccagaaauucaaggucauccugggcuacauagcagauuagauagaggccagcccaagaaacaucagacugccucaaacuacccacccaagaagggugugugugugugugacauuauuguuucuuuguugauuacaauuaaaauaaauucuuuaaaugacaaaaaaccaagaaugucuuuuuaguaugccuaaguuuuauauucauuguaagcaccccaucuuuuagcaggcuuggcagaaguaguagcuaacagcagaaaacccuggggacauaauucaauacaaauaaaaggcaggguuggugaaagccucuggucacgugggugggcgggcgggcgggcaagcgcgagccuucgcuacauucuuuuccaguaauugccaucgagccaaggccagccucacuugaaggaucccauuucuucuuccacuaggguggccaucucuggaaugugaguggguagagacaaggaaucucagaagccucugaacaucacagaaaaugcuggggcucgaggacaggguccugucaccaagggcagcuaaccaugguugaucgcuuuagcaacuaauaggugauccagucucugggaaacuguuugaaaauagaacccugcucauaccaugcacaaggcaggacaugaagaacagguguuuuuguuuuguuuuguuucuuuuuuuagacugccuccuuuguucaaaccucuucucugaguauccuugacgagagagguuccacagacaacucugagaccuccguucagcuauacuuaaaggaccauuuauuuauacacaggugguuggcucaagguaacaaagguaugaucagaguuuuccuucugagcuccaggguuacagagcuacacugcuacuguguaucccaaaaauaccucuguauuuucugacucaaacucugaagaccagaagacaaaaaguuuuacccugggcuggagagauggcuuagcgguuaagagcagugauugcucuuccggggguccugaguucaaaucccagcaaccacaugguggcucacaaccaucuguaaugggacccaauacccucuucuggugugucugaagauagcuacaguguacuuccauauaauaaauaaauaaaucuuaaaaaaaaaaaaguuucaccugaaggaugaggggacaggaguagacagucucuuguuuugugguucaguauuccuuucuaaagucuucacagaugucaccacccagaaaaccuccccccaggucauuuucuuagaugacauugggcaaugcaaugccggaacucccuccuuugauguaaaauauuaacaugucucauguaugagguugaugauaccuuugauagguguccacaaaacuagaaaggacuacaagcuugugaaacaaccacucccgcaggagaugucaccauagcuuuagaaacagggcaugguggggguggguggguaugggggacuuuugguauagcauuggaaauguaaaugagcuaaauaccuaauaaaaaauggaaaaaaaaaaaaagaaagaaagaaacagggcauggacaagcuacccuuuguugccaaggacacauggguucacucagauaggucgcuauuuguguccaucucuugaaagcugaagacaagaacuauaauguucuguuuauuagguacagaagcccuggguuggauacaccuagucaggcguauacaguaggaggcauuuagcaacucuuguucacaaaugaaauagcagaaacacagauagguaaaggauguggcccagccacauggcuaggaacagacaagaggcuguggucucugucuacacuguggcgagucgccuagguuaccuggcuauuaagugaagauuaacaggaaguagcuacagcuaccagcaaaagaucauuccguagacaagggccucagaaccacaaggauacuaacagaagagguuugaacaaaggaagaagucuaaagccagacucaagaaccucccuccuacaaagcaugccuuuagucccaucacuugggaggcagaggcaggcaaauuucuggguucaagaccagcuugaucuuauacagaguuccagaguucuacacagagacaccuugucuugaagaaccaaaaggaaaaagaaagaaagaaaaaaacaaacaaaaccuccacauuaugucaccacuugucauaaacugaaauaagcuguauuuccccuaauaggucacccauccccacuccugcaaggaccaggagcucgaaaggucauacuacacaagcaaacccccagccuguguuccuaaugccauagauaugugcgccuguguugaaaggagacucuggggugggggggggauuccaaggacaggaaacuuauuugcauuaaaguuaccagauuuucucccaacuucucuuaaauguccugguccaaaacaaagucacuaacuucacuaauucagaccaggaggccaggugugguggcauaccccuuuaauuccaacacucggaggcaggaggaucaagaggcuacagagcaaguuggagccuagaguggacuccuagugagacucugucucaaaaaacaacaucaacaaaaacaucucaaaggaggccagggauaacacccagaggagugcagcaaggagagcccagcaaaggcacagaagggagagaauucacucaggcucauuuaacccugacuucugagaguaaacaggacaaaggacacuccaucaucacccaggacugcccccccacccccagauguaaggucauucaugcugacuguagacauuggggcagugauuaucugcccagguucuaccucgccauguguuccaagcuccaugguaacuccagugagccaacuacaaucaacaggguaaaaccugccaucagccucagacaugagacguguuaauagucuugcagcuuggugaaugugguuaaacacauucaaggguucaggccccagucuugccucucuuuuacaccacagcucaccucugccaaggggcacuucccccacucacccccucaagaauguaaggauucuuucucaaaaaauauguggguuucuuuccucccaagaguugugacccaaggcagcugggguaacaaacacauaucagacagagaagguaacagggaccaaggugggugggacugauuuaaucaaggauagcagggaaggcuggacuuccagagacaugcucaagccacaaggcacaggguagugcagaagacccacccaagcuccuugugccugucacagccugggugcugcacagaagagccaggugagaacacagcagaugugaccacaguacuggaauugaaguuacgguagcugguagguauugaagucuacauaggcuugcaaccagcaauggccccuguuccuucaguucagaagagcuaagaucuccuccaucuaaagagccaagaucgccuccaucuacuuguccuucaugucaagaccaaggaaaagaaacagcagcuugaagucauuuuccucuccaggccccucuuagacaguccaguguccacaacccagguuucaauguuccuggaggcacuguccggugaggaggcaauucuuuuaagagaaacugaaauccggugcaagaagauggggaauuugucccuaccugcuguaauagggauaggguggggccagaaaugggccugaagagcuggcucaguuuuuaagagcacuuaacuucucuucugaagaugugguucaaaucccagcacccuccccagguaccucacaucugccuguaauucuaguuucaggggaucugauauccucucuucuggcccagcugacaccagcagacaaagggagacacauacagguuuaaaaaaaaagaaagaaagaaaaaaaaaaaaaaccuuuggcuuucaugccaagucagggcugugguguccuggcuuuuagcugcaagcagacaauaccaccgcacccuacugccuaaauacaggggugcucucuggcacugccacuggcuacagcccacggagcauuccuguggcuguuugggcgacuccacgacuuguuugcuuauugauuaggaaggaggcugcuucucuacuuuucccuucuguggauuuucccaagcccagagagaauccuguucuaaauuccauacagcugagucccccacccucaaccccugccaccccccgacaaaaggcaggcaggcaggccugagugccgcugagccaggcccuccuagcccucucuaguccuuaauguagccuuaugagcucucaggccuccagucccacucggggacuaaagcauguugaccaaaaugccuauaaucacccucucggaucugguguacagugcacauacuguccuggugugcuuugaaaacuacccaguccuggguccuaacuccaacuaacucaauacagauauccagagauggaagagcccaggaauuggcagaucuuaaauuuucuccaagcuccuauagaauccaaugugagcaaagaaucaccaauaaauaaauaaauaaauaaauaaauaaauaaaguaaguaaguaagucauugcaucaggcauaaagagggaaacaugacucagcaaaggcucagagauguuaaaugccucuuccaaggucacacagcauaaauggcaagaguagggcucaaacacugguugaauauagacgacucccacacagucuuucuccagccugaccugcuggguuuggggaauuuccuucacucccuuguccgggaauggaaagugagaacauaguccuuccacuuacuaacccugauggcuggguucuaaagugacggcacuccgucaggacgucuauuuugcacuccgacugggauuuggcuuaguuuugaauaucaacagcaaugccuucuguaugugcgugggagggaguguuacaaggugaaacugcagcguuagcuaacaugccagaguggagauagcagaugcugaaugacacaaaagaccacacagaccccgugccauuccuuugucacacucgaacgucccagaucaaaaagaucuacagauaggacuugggagauggcggguggcaaggggcacauuccuuuuuaauaacuaaauauauguuauauuuuuuucauuuuccucaaugugugaguguuuuagcuccaugucugucugucuguacaccacauggaugcuuaaugccacagaggucacagaaaggcaucaucagaucccuuagaacugggguuauagaugguggugaaccaccaugugggcgcugggaacagaacccgguuccucugugagaacagcaaacgcucuuaccuguugagccaucucucuaguacccaugaaaacgcucccaaguugaugggggaugguugcaaauucuguucauauaccaaaggcauuugauucacaugcgaaaugggaaugauaugugauaagugaauuaauacuuuucucuucucuucccucccccuucucuuuucaaaucugccuauaaaacaaaaacaaauaaaaagguggcugagagauggagagauggcuuggcuggaggguuaacuggagaguuaagagugcucacugcucuuacagaggaccugaguuugguucacagaacccuggggcagcucacaaccacccuguaacuccaacucugaaggaccuaaugcccuguucugacaccugagggcucaugcacucaugugguauacaugcauacacucaggcacacaugcagacacgugcauacacucaggcacacaugcagacacaugcaaacacccaggcacacaugcagacaccuauacuuuaaaacaaaacaaaccucuaaaagucuuacaaugaaucuauuguugccaggauggauaaauuaagcuauggcaacucacaacuccccaacaaauagaaacgccacauuuuccuuuugcaguguuuaggguagcaugcaggcccuugggcauguuaggccagcgcucugccuuugggcuacauuccuagcccucccaaaagcacagguauguaaagccucaacuacacuaagcauuaagugcucacccaaaaauguacuugucuuauuuacgcagcuacuagaaaaugaagagacugcggggugugguggcacaugcaaccuuugaucccagcacucaggaggcagaggcuugcagaacucugagccagccuaguuuacauccaugaaugaguucaggucagccaggacacauugcagacagaaagcaggcccacggaggccuggggcugaggcaaggcagguauuagauugccaauugacccaaagggggcuccugaguaaugcaaaucuaaaacuggauccgggugacgggugagccacugagugcaccuauaaaaauuaacacgcauuuccacugggcaaauuguaaggugugcaaauuacaacucaacgaacucgaagaaauauaguuauuaggguuucgugugagggguaccccaugagccaaagucuacacacccaauaauacugaggcugugaagaaguggagaaugacaaggucauaaacaguccuuaauuaacaguaauuacaggaguaacgaggagccaggugugguggcacaugccuguaauccaaacucuguggagguggagacaagaagaccaagaucauugucaucugcagacauuuuaaagcuugucuaggcuacagucucaauaaaacaaaauaggcaggucagacagguggcuuggcuggcaaggacaccugcugccaaaccugaaaacccaaguucaaccccagagaagcaugaagugaauuguuuuaugaccuccagaucccacuguggcguguguguacauggcguguguacacacacaugugcacgcacacacucauacuugcacacacaggcaacacugggagccaucuggguuuucuggggguuguauaguuguuguuuguuuaccuucuauuuuucaagacaggguuucucuguauagcucuggcuguccuggaacucacucugaagaccaggcuggcuuugaauucagagaucccccugccccugccccugccccugccuccugagugcuggaacuaaaaggauacaccaccaugccaggcuccuguuuguuuguuuguuuguuuguuuuuuaaagauuuauuuauuuauuauaugugaguauacuguagcugucuucagacacaccggaagagggcaucugaucucauuacagaugguugugagccacuaugugguugcugggauuugaacucaggaccuccggaagagcagauggugcucuuaacggcugagccaucucuccggccucucuuuuugguuuuaagcugauuuucuuuugggguuuugaaauagucucuuuggaacucaggcuggccuugaacucacgaagauccacuugcuucucugccucccaagugcugcgguuaaaggaaugcaccauugugcccagcugagguugggcuucugaucaccuucuugcugggggcagcucagagucaacagaaccagccaaccagaaacacucaucaauccagggccgcacuucccaagcacaaaagaauacagaaaugccacagcccaugugagaacaggggaaguugccauggaaguaagaacuuuuguuucagacagccuguguugcccaggcuggccuuuaacuccugggcucaagagguucuucugccucaggcucuggaguugcugagauuggaaauccagaauauucgguucauucaguagcucaagaaugagaugugaaaaccucuucuacagaggaagaacacgaggccugagcucuugccaaaugugggcugugccggaggagcggagacccuccgccuccgaccuuuaaacaaaacuccuaaacagacccaaagaaugucgaggaguccaagucacagagagaggccguuucucguucuccaggucacaugcaucagcagaugacucugugacaagcacccacuuguccaccagcgcuucuaagaggcggcuuuuucuuuaauggaugcuagcaucauuuuucauuauccaaaacaagcaagcauugaugggaaaggcagcugcuuccaagaguguuugcuaacccuacacagccugccuggaaagguaauuuacucagaaaauaagccccacaacaaugccgugucccucagaggggaggaggggaagguaucuccauuugggacguacauucuaagaauucaaggucagaaaacgugaaaaaaggaaacggaagagcuguggcgauagcucagugguacagugcuuagcagcuugccagagguucuggguucaaaccucucaguagcaccgaaaagguggggggaguaccacugaagagcccagaguaacgccguguauuauuguucugccaccccccuuuuuacuacaagcccucaagcccuacauuccuuucaguuacaguaaaaccugaccugcauuaaccccauaaaaguugagauaagaccccugccucagaguggccuugggccuauaguauaaagagucacaucgcaggacuaaaccucaauuuaugaauuccuucuucauugucuccugaauauugaucugcuugugauuuuaugcuucaaaaggagacuguugcugcuuucuggggggcaguugcugacuccgagcccaacuucaacccuaacuggguagaagcagcuagguugcuuuugguugauuucugaccuuggugggucccuuucucaucauuagcccuguucaccacgaguagugauuccagcacuggacggcagaggcaggaucaugaaucagaggcuggagugaguuugaauccagccugggcaccacaguaauacucugacaguaacaauuaacagcgaauuaaaaaaaaaaaaaaaaaaagaccaggcugcagauaucagaugcaggcuuuaguguacaauagcguacagccguaggucacauacucaagauaccacagucugagugcugugacaucugccccagaugagcuucucaaaucuuuuaccuccaugccugcgacucuuucaaaagacuccauuaucccuuuaccuagucuguucccaguuuccgauggaaucaagaauuggaaacuugcacacaugcaaauucccauucaagguuucucacuaaggcauuguuugcaaagcacaagccugggggacaacccaaggagccaccagugcaggauuaacuaaauaaaugauggcauuuucuuggggcaaacuauuaugcagcuguaagauaaauaaagcucuucacaccggggcguugagcaaacacuaauacauuaugucagugcugggcacaauggcucacgccuguaaggucagcaaugggaaaguugaggcaggaagaggauugucgcgagcuccaggucagcuccggaccagccuugaguuuuagaauggaaccccaucucaauaaacaaacagcagaauaauaaacauuuuuugcaaaugcucaggacuugggagcaagucacacaagguccuaccuggccacccccuggggacugagaacgucccuagaaucugugccucacaggacugaggaguccuuguggggaaggacaucugcaggguggugaggcaguugggaggcugacccacacaugagccaaagaggagggggaaccgcaggccgcugugggcugucuaaagagaaacauaacagaagccacgucugaugccuggcuccuccuacacccuuccuagcguucaucuguaaggcacagaggcugcacugaaccagcacagaugugggcucaagggcacaggaugcuggagcaagcacauauuagcauggaugggcaacauaucacuauguagccaggcugaacucuccaauaguccugccucuugcucuggucucucaaguucuagaaauauaaaaaugcacuaccacaucuggcucagucuaaugguuggaggcuauucuggcuaugcuuacagaucuuauacuugugaauccucuuuuccuacuucaauccacaagacuccggcaccugcccuagaggagcugaacaaggacgucagggcaggcuuguucucagugccacauaaacagcaaggcauagggcugaucucacacacucaacaggaaaggaugcagaaauucgaaaggaugcagcuaggcuguuuaugguggcaaaugccuggucuucauagugaguuccaggacagccaaagcuauauacaaagacccuguuuuaaaacaaaauaaaaacaaacaaacaaacaaaucccagcaccuggaggcaaagacagguggaucucugcgagucaaggccagccuggucuacagagaguuccaggacaguuaaggcuacacagggucucacuguauggcauggaacuguaugagaagaauuugucuuagaaaagcuaaggacaaggcggcacacccgggacccaccacucugaugacugagaaagaagaauugggaauuugaggccagccugggcuacacagaagaaagaccaugucuucuaacaaaaaaaaggcuaaaagggguggggugcgacucagcaaagcacuucccuagcaugaaggagguccuggguucaagccccaccacugcaaaagggggugggacuuuuccuguaucauuuaaauuggauuuggggggcaggggugagggaaugccugagugguccaaagcacuugcucuucaagccugagggccuguguuggaguccccaucacccacauaggaagcuggacauaacugcaugccugugaccucagcacugggguggacagagacaggcagauccagagcucucuggcugcccagccagcuuuacauuuagugagggaaacuuuguuuuuuccuuuuucuuuuuuuccaggacaggguuucucuguuguggcccugucuguccuggaacuggcuuugcagaccaggccgagaggaccuuucuuaagacaauaaggcuaagaaggaauacagcaaaggcaccugauccuguggguagccuccauguguguaagcauggauggguacaugcacuuacacucucacaugcaugugccauuacaauacaugcacacucaaucuaaguaaguaaagagguugcucuccucucuuuacguaacaaacguuuuccuugucuuuaacugagagcccaacugaaugaggaaccuguggucaacagcaaacaacugggugacauggcuuccaaaacccugagugugggucucaguugcauuaucgggcgaagacauuaaggacucagggagccuguggguuccgucagauucuuugcgguuugauaagaacaucuucagggcugcaaucuaacgacauaaaugauagaugauguuuugcucuuuccaaaagucaggcuuuaagagggacuuugaccccuggagcuagucccggggcacagggguaaugauaguaaguggcccucugcaaagggagagacagaaacggagaagaauccugagcgcuaagaguucauggcugacuucaccaggaagggccagucacacgggcaccugaggauaacgagaaaggccagcagagacuggaaacaaagauagcaaaggaacagagcuguuccuguacugagacuccucugauuggaccuaccccuuccugaaggccccuuuguugaccucugauuggaccagcccacuccgccccgccccuaaccaaagcccuuugcucuuuuagcacaggugccccacgcuacugccagggcugguuggaauuuggauaaaucugaacuagcuguggggcaucgggaaaacccacucgcccucuuucuaaaacagaaaguuggauacaguagcauuggggaggcaaaggcaagaaaaucuauuccaguuugagaccaaccugggcuacacaggguuuaagggugaccugggauacauaaaacaaaaacagacguaauggccguggaugauaagucauaccuguaacccuacacucugaaggcugaagcaggaaauuugucacaaaccugaauuguagggugaauucuuggccagccugagcuacagaauaacacugauucaaaauaacaaaaaaaaaaaaaaagucacugccucuuacagacucuauaaaaaaaaaaaaaaucugaagggagagccuaugaagugagcuacuaaguauugcugcugugauuacacugcaguggcccaauuggcagaacuagaauuuucugcagcugccucaggguagguggcgcccagguggcugagcaaccagcagggcucccuggccucagugcacacccuaagccuuggucaccccugccugcaggcguggcugccccuaccuguggggggugccugcacagcuccacucuggggaagcugauccguccccgccccuccucaucaaagcuucgguaccacagggaacagugucuguucgugccagccacucccuucccagaccacuuggaaacgaaucuguggacauaaaaggaagcucccuggguagcuauucugcuuuccugacccauccguaaagacucaggagugggcggagccaggguuuacuuagguuggagaaugggcaucagagaaaguugagucccugaaaugcuaagaacauggauauggaacauggauauucagauggaggcuccacaguguuggacugguaauucuccagagcaccucagacucucagaaaggaucccugccuuagagauaugcagagaggauuaaaauaggggagggggcuggagagacggccaucacucugagcauguccugcucuuccugccuggaguugggcucccagcuuucacguugggugugguucacaaccaauuauaagaccagcuccagaggaccuaguacaccuuuguacacagaugcacauauacacaaaagaaaaacccuuuuuaaaaauguggcccagguuuuaguguugaagauggaagugaaauaagaaaauucuggagaccccccccuguggccacaaugacuggcuauucccaauaccagcccuuuaacccaaacccucuaagcaccugcagaggaaucccuccaggccgaccugcauugcuguagauugcggaugggggcagcacuguggagggagggcagcacguccugggacaaaccacuggagcagcucaacacaucccacagggcagguagaggaccaaagugcugaugggacagauggcgcuggcacaggacccacuuagaaggagccucuggguacuuggacaaugcaggaacugcuucuaagagcugugccgauguuggcuccacaccuuggcuuuguuggcucuggcagaacuuuaaaaggccaucugaauaucccacaaaggccuucauuugcuuaaauaaaaagcaaagccuuuggguguagcucccagagaaagcccuggcuucucacaggaugccaggguuggguuggggguggggcuggggcugggggguggcccacagggcaaagcccuuucucuagucaguccugcaaauaccgugcauuaacccaacucuccccauugaugccagcuuuaaauaccuucauucuuaaugggccucuuuuuugcugacuggguacuucaggccagucacucucaagcuuucucucuuaaacacccucucaagcuaucagugcaggcucuccuggaaagccacuagcccuggccuccuucugaauauacaacauaucgauuguaucuaggcagguagcuggggcuucucagaauccugguugguuuguuuguuuuaaaggcugcaaagcaaaguuccucacaggaggugggcccaggaagacucacugguugguuuaggucauugccugagagauaggacagguuggaguagggaguucaaagcuagucugggcuccauagugagaaccuaucucaacaaggacaaaaggaaacaaaaauaaaaaggcuggcaagauggcucagcgggcaaaggcaugcagccaaguaaaaugacggcaggagaagacgcucauguuuucaaaccuccaugugcacaacgugguaugugugcacagacacaaacccaaaaguagauaaaauauaauaauaacaaaaacaagggacuggagagauggcucagcagcuaaaagcacuggcugcucuuccagagguccugaguucaauucccagcaaccacgugguggcucacagccaucuguaaugagaucucugaugcccucuucugaagacaucuauauuguacucauauacauaaaauaaauaauuuuuaaaacauaaaagcaaagcaaaaggaaacugguagguaauauuuaaaaguaauuaguauuuguccuuggcaaucaauuuuuaaaaucaaaacuacuguuaauaacacaaaauucagugguuuggauauagucuccaucuuguguagcaauaaccaguuucuaccuccagaacgcccuggccacuccccuaggcaacucugugcccaguagcuggucuccuccgauccccuguggccacucauccuuccugcucuggguauucugugcacaucuggugccuggucuagcauuuucuuuuuuucuauuuguacggcaguucaaaaucaaguaauacauguuugauggagacuauaaagauugcaucugggucccaggcuagcagucugcagccugcagcacucggccacugggcacuaugcuguauugcuaaaccauuuugcaguguuccaacugcacuuccaacuuagcaggauguuacccacuguaaguccagaagcuugugacgugagaggucaagugucccgcucugccucagucugauguuucauuuguuuuccaucuuucccagauagccucacuauauaugcauagccuuggcuggcuuugaauugccugcguggcccagguuggccuuaaacucagccaucuaagagguaugcauauaguucccugccuaguacugcuaauagcuguuuucagguguggcguguguguuccugggagugaagaagauauauauguuugggcagaaguagaugcuggauucccuucucuauuauucucuaccuuaaaaaaaaaauuuuuuuuugagacagugccucauguagccuaggcuuacgacuuagcaaaaauguccuugugcuggaauggaccaccaugaccaguuuaugcagcacugcagaacaaguccaggguuucauacacagcagacaagcacagcuugagcucuggauaaaccagaacucacuguguggacuaggcuagcuucaaacuuccaacguuccucuugccucugcugagcaguaaguaugcugugcugcuaaaccauucugcaguguacuaacugcacuuccaacuuuuaugauuacaagccugugacuccaaaccuggauggaaaacaauccaccacacgugaggcccaggcagaacugccacacgucugaggccagccuggucuauacaguugagcuccaggccugccuccagggacaaacagaaucagcuuucucuccuagauugcccgcuuugaggaaagaagucuguaaaggacagacagaccugggggcuugaccuucaugacuaacugcagcagcaucugcaucaaagcccuuuguuccuuguggaaguaacaugcagacacuaccagacacuucagauccagaaacgccagcuugccuuuauuacagggggagacauuauaugucuuuuuaaauuacaaacuugagcucuguguguggcuauuugugcgcauagauguagcuuauaugaaauccaugugcuuaaaaacacaaaaccagaaucuugacuccuauaauccaauaagaugcuuccuggcucaacccccaagagggagaagaaagagggauaggcaggcugaucaaaggcaggacuaccuccccuucuuuacauucuugacuguacagaauuggaggucaugucugagaugccuugcguuuaaguuccuacacuaaauaaaacauucuugggauaguuggggguguuugaauauggacuagacagcaaaugauacuguaaaucuccuacccaugagaacgggcagcaugguucagaaggggcaucaggcaucuuauccugacucauggaaugcuuuguuuuccuaaauacugacuuauuguuuggaauugaacaagcuggggcuggaaagauggcucagcagucaaaggugugcacuguucuugcagaggacccacauucgguucccagcacccauguuagguggcucaugaccaucuguaacuccaccucuggggauccgacaccuucuggccucuaaaugugugcauggccacacauauacagaaguuuuuaaaaauaaaauuagccagguguaguggugccugacuuucauugcagcacuugggaggccaaccuuuccccccaucccgcugcccuccuccccccagccuccaggaagcaccagggugaggacuucucaaccucugagugacccgcacuugcaaaugccugacacaaagcaacaagcuccauucacagaaugaacugcagaaggagguggcuccuugcaccucugggaaguuguuuuuuuuuuuuuuuuuuuuuuuuuauaacuaaaacauuuggggauaagggaagauccuacagaagaacucaaagcgagcauccaaccaugugcacaccgaggacacgauggaggcugacgugccaugagagcugcucacuccgcugcccugauggccucugcccugccccugggcauuuucccuaugcccacguggcucugcagcugcugcccaaggcaccucugaccaccacuaaaaaggucuaacacaaaaccaggcagcugccuguggugccagcacuagcagaauaaguaaggcaggaaggucaagaguucaaguccagcccgucucaaaagggucuguuugagaaccugucuccucaggagucgggagcagguaagaguuugaggcuagccugguuuacagauaggguucuaggacagcaagagcuauguagagagagacccuaucuugaaagaaaagaggaggaggaggaagaagagaaagagggaaggggaggaggaggacaagcagcagcagaaaagcaugucuuugaacuuaagguaagcacuuuaucgacugcccuauuccuccagcuuccuaguucuaucacucuuaaaacaaauauccugggcuggagagguggcucagcaguuaagagcacugacugcucuaccggaggucccgaguucaauucccagcaaccacauggugacucacaaccaacuguaaugguaucugaugcccucuucuagugugucugaagacagcuacacuguacucauauaaaauaaauaaauaaaucuuuaaaauaaacaaauguccagcacccaugacucagagacagguggaucucugugaauuccagguaagccuaggcuacacugagaagcccugucucaaaccugccugucccuuucucucccagucccaccccccacacacaccucucccuguccuucccccgacaggaaccuuuguccuuaaaucucagaaccucaguucacuucacugcaagguggagauaacaguccucuacagcaucuguuuggagagugcacauuccuuccagcacaagugaugaauuagcggacaacuuaagcauagcccagaggucuaccucacuuaagauuaacucagaggcuacuucucuuaugggugugaugauuucugcugcaagaaacaccaggugaaugcagaaaauuacacccagcugcaaaguaggaaggcacaaagccgaagcccgugacaugccacauccacugacaucuagagcucaaacucuaccagauagaucucucucugauaacccuugucccgaccacagcugcacaguaacagguacaaaacacguacgaaguucuuguaaggcaucaguuuaagugugguguuucuuuuuuuuuaauauuuauuuauuuauuuauuuauuuauuuauuuauuauauguaaguacacuguagugugucuucagacacuccagaagagagcaucagauuucguuacagaugguuguaagccaucaugugguuguugggauuugaacucaggaccuucauaagaacagucagugcucuuaaccgcugagccaucucuccagccccaaguaugguguuucuuucugcuuuauuuuuuaaaagagacagggaccugggaccuggcaugguggcauaugccuuuagucccagcacauggaaggcagaagcagaaacagaggcaaaaagaucucuaggaguucaaggccaugagaagaguuccagggcagacaaggcuacauauauugagacuaucucagucagucacacacacacacacacacacacacacacacacacacacacacacacacagacacaggguccugcuauguuaccucaucuucacuuaggcucaagggauuuuccugccucaacuccacaagaacuaagacuauagguauuacuaacaccacacuucccccuccuacauuacaugaugaacuuacagucgcuaagcuucaaaccccauucucccacuggccgguggcuugugucaguccauuuccauagugacuuuugaggaagcuacaucagguuucaagacaaugaacuauauagugcauaccuagaagcuaugggguaaggcucugguaagauugcacccagcacuuggaaggcagauuucugucucggaaacaaacaguaauaaacaaaacccacaaguaaguuaacauacuaucagaauagugauaguuccccuuggcacugugacacacagaauaaguguuugcuuuaauacugacugcugcuccagggcuagaacugaaaugagcaggaacucaccagcaaggaaugucagagucagcugggaccaaaaggcaggauauugagagcagcgcuaauccccaucaaacaugccccucggaucguuucugacacaagaugcugggcugagccauacccagugaugaaugagcuguguuauucuggucuccugcaauuguuuccaaaggacccagaagcuccugggcugaaggaacaaggaacgcacucacuuacuacucacgugcacacaccagugcaccacacccaccguaugcuuggccagaaggaagaaucgguuugaacacagacucaucacuccaucuuggcagaagcugauggauacagaggcaguuacccagucuucagaacugagaggcuggacccuggauaucauuuccauaacugugcagcaccuacagacccucaaggaucucagucacgggccuuggccuuuuccuucucggcacacugugcucauucugucuggagacucccugccuugguuguucuagaaccuucuuucuacucuucucauggaguccuuccucuauuagagaaucucuuuugcuuuuucucuugcagacuacucucuucaauccaggaccacccacaugcuagguacucuaucucugcacuauaucccuccccaauuuucuaaaaguggagauaaacaguauucuuuuuauaucuggauuuuuuuuuuucuuuuuaaaucucuggcugaugccugaaauggcacaccuuuaaucccagcacuuugggaggcaaguggacgccugagucuuugaggccaaccuggucuacagagcuaguucaagugaagucaaggcaaaagaacuguaacuggaggaguggggagagaaaaggagagagauccauauuccuggagccucgaugguagagcacuugccuagcauguguagcagguaaggugcuggguucaauucccagcaccugaucucaugcagcgagugugaggggggcgggguggggaggaucacuugaaaauuuucuaucagcaaccaaugaaauaaagcagguugcaccuucaaggagccuacauuuggaggggggggauguuggagaagcaaucaaauagcauacaguauuaagcuggauuauaauaaaggcuaugaaaaaggaacuguacauuuuauuaugugguagacuccacuaugggggaagcuuuaacagagccuggaguuauaagcuauaugccaaggcaaaggugcccagcagagggaauaguaaacacgugacccugaggcggcagagugcuggguagugaauagcauuaguaaaauccccaccauuacauaguuaugcuaugcauuauacaagacagaucuuacccggggagugggggagugcaaagaugcaaaaaugcuccucauggagcuguguagguggugacacacaugacugaaaucucugcccucuauugugcaauguuguccacccaagcauuaguugguuaucuaguaaagacaauugcaaaugggaagucuagcacauuagaguggugggagcuacaaugaagcaagaacucucuggaggagccaggcaccccacuaauggccagcacacugaaguccagcaggagggcugaucagauuucccucuuuauuuugccuggcaggaacagaggcaaauuuguggucugcuuucugcagaguucuaagcuguauggcacucacuuugccacucagcccuccuccucuuaucuuuauuuucccuuuguuuucccccuugugccugagauacggaugucaacaaauucuucacuggagcagguaaggauggaaggagggaagcagcaaaggagcaaaguucucaguuuagucuugaaaagagggcaucggcaucaggacacaggaaauucccacugcugggaaaaauucuaaauuucucacuuuuccagcacgcuccugguuguccaauaucacuguucuauugcugaagaggcaugugacuuaaggaacucauauccaaaaaagcguuuaacuggggacuugucuaacaguuucaaaaguuuggcccauuaaucaucaugguggcuugaauggugcuggagcaguagcugagagcuacaaccugauccaaagaggcagacagacagacagacagacacauacacacacacacacacacacacuggucuugacaugggcuuuugaaaccucaaagcccaccuccagugacauacuucccccaacaaggccacaccccuaauccuucuaauccuuucaaaugaugccacuccccagugaguaagcauuccaguuuaugagccuaauaggagccauucucuggucuggcucaucaggcuccaucauaagagaaucaaauggccuuccacaguaauaguaucucagagaucuccagaucaguauugaugaccagagauagaggccaaaguuuccucaaugagaagguuagaccugugaccccagcacucagaggacuuacagucagaagacuaggugcuaaaggcccugguggcuaaaauagugaguuuggggucaaccgaagcuacaugagaccccccugucaaggaaagauaagagacagagacacaaagacagagacagagagaacuaaaguaaaccugucacugguuaacuuguuacaagcaaaacaaauaaaugugaaaaacccucaggcucaugacuaauugcccuuucuaaaauaccaggcaaacaacuuggcagugguggugcgugccuuuaauuccaauacucaggaaacagaagcaggcaaaucuugaguuugaggacagucuagucuauagcaugaguucuaggacagccgggggaaaagagaaaccucaaaacaauaaacaacccccccccaaaaaguaccaggaauacauuuaaaaucaaauaucuguaacgcauuauguguucccuagaccugcuaucaaaccccaaaaucaaugaaucauaaacuaaaucagcacacacacacacacacccauaggaaagcaaaauaacgccccaucuguaguaaagaaaguccugaaauucuuggcccugcccaaaagugaaacuguagcugucuuaucuccauguuugaucuggucucugcucaguuugaguuucacacuggcuucucccagggcuuaguucaccguagauuuuuaacacugggcugggcaacucauaaacuagggagccguguuuauggauggaacaguccaaggucacgggaguuaauuuguaaagucacccacugguguggauuaaccaagccacucucccagcgagaagaaaaggcagacugaaggcuggauggacagagccaggucccuuggccauccagccucuucaacucuggaauucugucacacaucuuacauagccugcuugccugcuuaaaucuguucuucagaacacacgacucucagcacccgggaagcaaaggcacaagaucgggaccagccaaucuacaugacuuccagucacucagagcucaaaaagaaaaaagaagcggggagaaggacagggaggaggaggguacaguguacugucauuguugcccuacauuucuaccuggaaggacccugagauucauccccacuuuagaccugauucuacuucaggggugaaucaacacuucaaggagaauuuauaucccucaggggggaaaugugugcccauaaacagauaaaggggaauucagaguucaguguuauccuuggcuacauagcacacuugaaacaacugugugugugcaaggcauacagacacacuuacacauuggcacacuugcacacacacacacacacacacacacaccuugucuacaacuugaaguggcuucuccucacuccccaagucaagaaccaucagggagaguuucuaaauaaaccaucaaaccaucaacuaccaacaggucucuggccuccguuccuuaagauggacaggccugucagggucugugcuuugggggcaaacaaugucucucuauguagcccuggauguccuggaacucacagagaucuaccugcuucugccuccugaguacugggaucaaaggccugagccaccacauccagcgagagucuacgcuuuuaagcuuucuaggugaggcacuccccagcguaggcuugagaacgugcguucugguccagaugauccuuauaguaggaccaaaaagacaguccacagcccuaggccaagagguagaggcaggcagaccguuaggaguuugaggcuauccuagucuacacagugaguuccagaccgcccaaggcuaguaaagacccugucaaaagaaaaagaaacaaaaggggagaaaaaaggaaggaaaccuaccuagccuacaagaggucccauguccacccucagggcuauaaaaauaagugaaguuaaaaugcccaguccuugacagaccucaucccaaauauuuacgucagagucccuaggaauggauuuuuccuuagguaccaccacccuguagaaauacacugaggagcacaggggguggcacacaccugaaaucccaacagaggcagacagauacagauguaaaggcuaacccggagugugggggagcagagcuuaguaguuuagcaguaaaguguuugccuaggagacagguggcucuagacucauucccagcacugaagagacagacuagcagcucauuaaaaguaaaggcuuuccccagaauucggcagaaagcccuuuaacaauugauuaauuacucagcauuuccaaagauggagcuacagacaaaaggauuaagaggcugccucccuuuccccauucaucuggcuccuuagucuccccuguagguucaccucacccuuccacccacuacccuagccugccuuucuaaaccucagucuccuguuuguaaagaggggcagaaaggacugcagcaauaaaggaauuggacgugggacgcccccugucucaucucaauccuuugucuccuccgcauuggaccuauugauugcuauugauugauucugcauaaucugccucuccuccccaccugaugccaggaggaacagguugcccacauuuucacaggggacucugcagacucucugggcuggugcaggaugggcuguuggguacgcuuaagagugaacagaagccgggcagugguggcgcacaccuuuaaucccagcacucgggaggcagaggcaggcagauuucugaguucaaggccagccuggucuauaaaguggguuucaggauagccagggcuauacgagaaacccugucucaaaaaaaccaaaaauaaauaaauaaauaaauaaauaaauauuacaaauaaauaaaggguggccagaaagagggcaucagccgcgugcacgugugcgcgcacgcauguacacacacacacacguacacacacguacacacacacacacacacacacacacacacacacacacacacacacacacacgaugguuauaagaacaaagccaggaaaagaauccgacuuuccuguaaugaccuccccuccugucucuggggucccugaggcccaguucacaccucuccuaacugcuuagcgaguacuugagacaccaggugcuacucuggggaaacaggagaagccagugaacuucugcucuugaaaagaagccaagggaauggagauuagagaaggcuuccuggaggaagcauccaaugagcugaccuaacaguaggucuagcagcugggcaggaagcccagccaaguaccugcuggaaaggaagacagaaugugccagcugguagcagggaaccuagcggcacuaucaagaaugugaaucagggcccccacccugugccaccuggaucagaacccaaaggagaacaagggcucugaccagcugggaaccagagcagccagaggcugguguccaagccauuagcuauuaagacccuacugcuuguaaugggggugggggugggggaauaggcuagaggggucugagaguccuugucacaaaauggugccagggccucuguacagugccaccuaccucugugcuccuccugucuccugcugcccaccaccuaccugacucuacacacacugcccuuugcucagaggcuccguccuggcugugcccuuaaggcugcccccagccucugagcucuccccuaccacagcucuccaucuucaggcccagaaugaaugaacaaacaaacaaacaaacaagaugucugguaagcgaggaugcugccauuugcugagaugggcuccuagacgaaucuagaagcaaauggaaggggagggcugggagggagaagggcagucacagaacagggcagucacagagcagccccagaggucacaccaggccuggucugaccaugcaagccucuccaugggauagggaacaacacacccuuccuccucgcggguuuccagcuagccuggggcaggagagggaagagggccugcuggcuacuccaagcucuccaggauuucccaccucgauggcauccuaacaggccccagcccuauugcagacagucucuaugaccugggaaggacagucaggaaccaagaacaagcuuccaacaggaaguuugcucacagaccccgccccugucaugugagucaucguucaaacaucccuuugcucuggaaucuugugagggggggaucaccccccuccuuugcuuacuguggcccuccccucucagccagcagagagacugccucuucccucugcgcaugagcugcacccccugaggcuccgacagcugcuccagcccacacaggccuggccccaccugcauucucaaugugcccauugucugauaacuuggcaccccagcacuuuccaccaccucagaucccucuccagacccccuugggacauggggaggcuugugaccaacacaaaacuccugggaggcccucacggggugcagaggaggagugugugacggucggaaguagcaaaagcaccuuuccuaugggaagcuguucccacagacaaaacuauccaaggccuguugggaaggaagcaguuuuauauucuuuuuuuuaagauuuguuuauuuauuauauguaaguacacuguagcuaucuucagacacucuagaagagggagucagaucucguuaccgauggugagccaccaagugguugcugggauuugaacucaggaccucugugcucuuaccugcugauccaucucaccagcccccgcaguuuuauauucuuauucauggaaaacuccauuuaaaagaugaaauggggaaaaaaaaaaaaagccaaaccaccaggaagguguccacuagagucacguggaguuggucacagaggccacugagucagggagggagcuggagacuauggaaguuuccuuaucucugauccauauuuagauuuugguggagagguuccccucccaguuucagacuuaacagaguuuaagguuuggaaaacaucuacagaaaacaaaauaguugcucaugcaaagcgucugugguggugcggcuccgucucuccccauuguugccagcuacguaacuccacagaguucccucaccgugaacacccuccccuccaucacuaccaccguccaacaacuguccuuggcacucacagaguuaacugccuccacucccccucccacucccaccaaagugauuacuagaaaacuccuagguaguaauuuggaaaagaaaaaaaaaaaauagugauuaaaaggagcugggagaaagcggaagcacggaagcacggaagcacugcccacuuccaccuccaggugaccagauuucaagggagcacaaggcgggcaguaaguaaugcccuucuguuacaggcuucauuagcagucaggagcuugaggcuccaaguacccaaaggaccagagauagaaauggacugcaugggggcagggagcgcucagguuccuuccugggagcuugaaagugaacaaccccagguagggcugagcacagggagggggaauguaggcuggguugagaguagcuuuaucauguagaucucggcuggggacccugggauaguaagcagcuuuuacaagcuuccacuauauaucauuuggaaauggaauuaucuauauaguaacuaaaguuggugcaaagauuaaaaaucaaagucacacaucaacagcuaguuuaguauucaauggaggcacgccaugaacacuguagcuauuguuuggugaaaaauguuuccagucuggcucugaccccuggccaguucuucugcauucccugaacuugcuaauuuauguacaaacuaaagaacuagagggggcugaagagauggugcagugguuaagagcacauacuguucuugcagaggacuccaguucgauucccagcaccaccggagaaggcucgcagcuggggaggggggguugucucagggccuccugggcaccugcacuugugcacuuagguauuccuauuguucaggaggaaggauucgggaagaggagaacaaggaaguuucuaaaucagacuccuaucaccauaucuacagacaaagcagacggccccuguaaagccagugcuguuggggacacgaggaucaucucaaguuggaggccaaucuggauuacaucaucauucuaaggccugccugagcuauagagacccucucucaaaaacagcaacaacacaacaacaaaaaccaaaaacaaaccccuccauaugcuuaagcaccaggcacugaaagcagaagugaaugaauguuagcucacuggcucccuaucuccuuucacagguaaagggacagacggacugagguuaagcaauuuacugagguccaauggcaaggaggggccgcuguccaggccacccaggcccucuccucccucccugcugacugucauucuauguugccgcuguaauuucaccagcugaagaaagagcaagcacucaggagucaucuugacaucugcugauuaaccugacacuuggugacccggucccuaggguuuuuuuguuuuuuuuuucccccucuuaagacagggucucaucugaaagguauuuacuucccucccagguuuuaaggacuccuauuguucaagcgaaaggauuagcaagagaaggggggaaaggggagaaggcguaacagacuccagaagaaaaaccagcugaggcggccgaugaugaggaaauuucaaaaccaaagacuccaaucugagcccagagaccugugaggugcaccaagggugugagugaguuccuuccuucuucacugugaaauagucuccuaaugcugcccagacucacccuaaauuuccaggcuagauccuucugccucagucuccccgauggcuaggguaacagguagauguagacagggguucuccuuucagauguagauuagaaguucacccccuuuauuuuaugggcuuucuccacgggcuuagucaggccugagagcuggguggucaugaaacuggcuaccugaacuucaccaagaagcuacuaaacaccagccaugucugcagaacuccugagcaggaagccagggagaagggacaaauaacacguacagugagggaccuuggaacaaucaacccuaaauggaaugaauaccucugccaaaucccucaccuugggggccccagggagcccagcaaagaggagauuggaggacaucaaggaaacacaauuugaacaaugcaggcaugaacucagagacuguggcaggacgcauagggucugcaggggucugcaccaaacgggggacauuagagcugaguaaaguggacacacggccccaccccuaaccuagaagcuaucucaaacuacuaaccacuugcaaaugaaaaacuaguucaugaaaaauucucuaagagagaaacacaccacucaguuuaagggcccaugccggccaacacaaaacaaacucaacagcagcuugggaaguugucccauaauguugugccaggacauuuguuucuaaucuuacaggccauguacauauauuacggcuuccgguuuuguuuuuauggacccccuguuugcauguaaacgucugugucugcgucucuuaagcuuucucuuuaacuuuuucccuugucuguucuguccuauuuccaguuugcuuucaccuuauuauuccucuuuuagauuccuguuugcuaaggagagagacggcuugaaaggguguagauccagaugggugaugucaugguugauucacucuuugaaagagaaaccuucccaggugagaccucucuaugacucaggacccugccccaccuguuaaaguacccagguaugucccacuccugacucagagugugacguuuucugauaggaaagccacgacuuucccacaaacagguuggucagcuuguucccuuuucaaacacucccacacgggcauugugagaaaucugugggggaggaggucugcagucucaagucuugcugguguccacaucagcagcgggucaccaagggcagcgcccaaaagguugugauacaaauggacaaucucuccagacugccaugagaacacuggagaaccaggcuagagccauuuuccuuaggcaacaagccaagaggugggguggcuaggaaaagagcauucgauucugguuugaaccggauacccuuugaaagaugccagggcuguucccgcccucaggcuuguucagugaaugcuaccaauaagugcuugaaagcaugggaggucagcacccacaggauccaaucuaacuuuaugcaaaguccaaucgguuccauguuuuuaaacccauacugggcuuaagcccauggcugguggggucuaccuuuaaccccagagcuccagaggcagaggcagguggaucucugaguucaaggucagccuggucuacaaaguaagacccaggacagccagggcuacacagaaaaauccagucucagaaaauagauggaugggcaagccuggagcccauauaucuuagacaaggacucuaauacugagcuauuucacaacaauuuuuugcuuuuuauuuauguuuuacuuuuuuccuggguguguacuguguaaguggaggugugugucacuaaucuuagcacuugggaggcagaagcuagcaaaucucuguggguuccagggcagcauggucuacauagcuggucuacaaaggcuacaugguaagaccuugucucaaaaagauguaauguccuguauucugauuuggcacuccuguccaugaaagagaaugguguaucuuccauauggauguagaacuccacuaucaauggauauuggcuggucaauagacccaagagcugguaucugauggggguagcuuugcauuuuugucuuugagcuuucuacaucucucuucuagcuccuuccaagaugcucagaccugccaagaacuagaaggccuugaacaauuaaugggcugcaggaugaagguugagagggcacagcugagagagccugcuucaggaaugugcugccugacgacggaaaggcagccggugucggguguaccuugagacuuccaucuggugcuuccauacacccagaagugugaggcccaagugacucaucugaccuuuagacucugggcagcaaacuucuuuguaacaagacaauuagguaagguuacacuguagcugugcagggcucagagaaaccagggggugccaagaagaaacacagggccugagaacauagcaucccuuccucaugugcucacacgcugacagcccuguaucuguuugcuaguuugguguguguguguguuggggggggggggguuuacaggggguauggugcgcaucuggaagucacaggauaaauggguucuggaaaaauaaaacccaggaugccaaaagguacaacauuuacauuuacucugagccaugucacuggaccccauuuuaucuuagaaaaaacaaaacccacagcacagcuucuaaaaagaacuguacagcgccauauuuaccuucuggaccucucacuccuccguucacucauucaacagaugaggucuaagaacuuguuacggccugaaguacagcucaagaaccaacaaacacagaacacccugaccuccucacauuuaugguuuugguuuuuuuuuuuuuuuuuuuuuuuuuuugguuuugagacaggguuucucuauagcccuggcuguccuggaacucacuuuguagaccaggcuggccucgaacucagaaauccaccugccucugccucccgagugcugggauuaaaggcaugcgccaccacguccggccacauuuauguuuuuauggaagaagacuaugaacugaggaaauacacaaaccacaugacagguucaaugguggaaaauaccagaaaggcugggauguggaucagcaauaggguacuugcauaaccugcauaaggcccuguugucucaucccuaccaaaaccacccaaaaaacggggagguggggggcuacagaaaaauaaagcaaaaagagaagguccucauugcccaggcaacaucuuaaugucucaucccuaccaaaaccacccaaaaaacggggagguggggggcuacagaaaaauaaagcaaaaagagaagguccucauugcccaggcaacaucuuagcaaagcuuugaagggcacgggugagugauacagacaucacaaacaaggaauacauagagugugauuggacacaccugagaugcuacuacucccggacaggaguauuaagaguucaaaaccagccucagcccgagcugccaugguauucugaguacaaucaggaagcaaagcaucugaacgaagcacauguggggagugggguuaaaaugaaggcccaagccaugggcugcgggggaaggagggacccagagccuuggaagucaugggcaggauuuuuauucagugucaaacagggaaucccaggcaacuuuaaacaggaugaguacuuaucacucuggccaggaguaguagcacaucccuuuagucucagcacuugagaggcagaggcaaaggcaaguggauagauaugccucucugaguuugaagccagccacaucuacauagugaguuccaggcccaaggcuacauaaugagacccugucucauuaacacacacacacacacacacacacacacacacacugaccacuggacggagaaaaggcgauguggggagagaagggaaggaacagggaggagaaccccaaaaaaagcugcugcaggaccuccuuuggaaacagauggcucugcaugccaaaccacaggaacagguguuaguuuagucuugaacuuguccagguaaaauaaauccgaaacacuuucggcuucuuacaagcucuccuaauuacaaagcuaaguaauuauuaucuaggacgaggccaauuaucccacaggggccggugcugguccccauuuaugagcuggcucauggggaacagguucaucuucaggcacaccacaucagguccucgugguagcaucuaagcaucaucgcuuccccgccgcucacaucucccacgucugucugccuuaugugcccuaagcaaguccuaguuggaacucacuuguuagagguguggacugguuuccuucccaccucuccaugccugaacgaagaucuccccuccccaccucaccccccaacaggacccagaaaacugaguaagacaggccuguucagauagcacguaucagauguaugugaaggucaagaggcugagucucaggcccaccaucucacguacaaggcggugggcugaugcaggaggcugcagaguaagcucaaaaccagccuggguagcagugagacccugucucgaauuaauuaaguuuuuaaaaagcaagaggauggagcuguaucucaaggguagagggccugccuaggaguuaggguccucugcauagcaauaaagaagggaaaggaugugaaaggcaaaggggggaggggagcccucucaaagacaaauaacugaauuuuaacaccacaaaaaucaaugagauugaggcacagagaugagggaugucuuuccuagccucaggaaaggaaguggguuucucaggaagggcaaugggcuccacgggacagccuugagucugguaacaggcagaggaaaauuggguaagauuccuguuucugcuuuuccucaaugcuaggaaucaaagucagggccucacacucauuagguuuagccugaccacagagccacaccccaugacuaucucugccuuuuccacagaagaucuugagaaggcuaaccaagagaauucuguucaggggaagcucugggugaggagucagggugaagaggaagucucagugccagccauaaguaaacauuuguucauacugaguucgaggccagcccggucuaccuagcaaguuccaggacagccaggaaugaauacacagggaaacucugucuggaaagcccgggagguggggaggggggaacagaaagagaaaaaaagccucaccaguggauaaaaaggcccaagguccugggggagacuuuccuuuacugugccuggacacauccucuuacuuacaaaggcccagcauguaaaacugaucaugccugcugugcuggccccucuucccaaauacccugcagaagucucaguaagcagagauguuucugaacuucccugaggacagaggcuggaucucugaugcacuggcuacauuuccggguccccuagcaccauggaccacgggugcucuuggaucuugggccucaggguagauagccaaaugcccacacccugguuggcaccggguguuuacuagucaaacaccugugaccugacuccuggucugucaggaaaaugaauguuguguccauccgugugguaccguggcccuuuaaaauccuagcacuugggaggcagaggcaggcggaucuuuuuuugguugagguucaguaaauugggggagggagguuaaucuguauuugugaauggcaccagaugacucaauucuuauccauggggggugaaccagucucagaagcugggucagagagcauuuugcaaugggucaacaaauggguauccuuaagcauguguauuaugaaauaguucuagaaaaagugaggguuuggggaacaacaaacuugaggccauccugaauccccaacccccagcuacucuggggcccuacuuccagcccaguuugaacccuuucuaaggcacagcaaacccacucccggcauugcaaggaagaaaacaccauuggacuuccuucucuaacaaaggcaagcuccuggucaaccguuugcaaagcaguguuugcuuaguacagaagcccggggaaugaggaaacugguuugacugguuugcugggcgggagagagcuuaggggaacuuucaaccaacuuuagaaccaaggguauaauggaaagggaaaggcuucuacugcuagcccgcaggggguccuacauacucuacuguauucacugaacuuuugguauaugcccuuaggauacguaugcauaugguuauacccauuuuggagauggggauacuaaggcuuagagaagacaggccuggcaagagucccagcuaggggcucuuggguggugcacacugguuauuccaacacuuaggagguauaagugagacgacccgacauucuaagccugaugaguucgaagccagcucguaagagcauagaguggugaaucccuguauaucaacacccaggcaggaggcaggcagaucucugaccaaccuagggagcucugggccagccaaggcuacccagugagugucaaaaaauaaagacggaagaaaaaaaaucacuaaaaaagacuaaucguucauuucuagguccgaguuugaugcgucccuucuguggcuucagaagcucugagagagaaggaagaggcuaaggccaggcucagcuuccagggagacugcuaggcagagcccucacaaguacaaucagagauuccagcagaccuaccgugcccugcucacuuuccugggccgggggugcucuggggacacagaauagagccugaaagguagcaaagauugauucaugcauccauucauuuguucaaaacaagacuugcaggccuacugggugccuaagaaauuacuuuuuuuuccuucuguuuccuccuccuccucuuacuaaaacaagguugagaccuuguuuaguauguagcccuagcuagccugaaccccacuacagaaucagauuguccuuauugaacuucuaacaauccuccugccuuauauuucaccgugauaaauauuuuuuaaaagccugcuccccaaaaaaaggcaggguuccacaggcagcccaggcuagccucacacuugagacccucugccucagccuucgaagcacuggaauacagauguggaccaucacagcuggcuuuauuuagugauucuugguaaauuucugaagcaacuuaagagacuggaagcagaaaaaaagacugaagacugaccucaacagacaggacuguuuauuucaaacagugcaggacagauacucucccguaggggaggggugucugugaaagguggaggggcacuugaggcuuauauaggugguuuuggggaauacgacugcuaagguucuuuacagccggcaguuucuccuuccuggaguuauuuauccagacaaggcugauuuaucuuuacaaacggucuagcccuggcuaucaugaugugggucauagagggagacugaguuuggcaauagcagugaugagggaggggaccagaguuucacuauaggacuuuggucaggguguggaagagugcaagacuuuuuuccuuuaaucuuccuuugaaacaggguuucacuguauaggccuacaauuuccuauguagaccaggcugcccuugaacucugccuucugggugcuaugauuaaaugccugaaccaccagacuuggcuuuaaaaacaaacaaaacauaacaggaacaaaacaaacaaacaaacauuacuuaaguguacacucacauauaaguauggagguuagagaauaacccuuggaaguucuuucuuuccuaccacguggauccuguggaccaaauucaggucuucagccucgauggcaggugccuuuccccacugauuuuuuuuuuuuuuuuuggacaggauuucucuguggagcccugaugacuguccuugaacucagagguccgccuggcucugucuccaaggugcacugccacacccaacucacugguccuacuuaugccagcauucuuuacauucaugcauuccaccccccucccauauuuauguucagccaaauacguuuuacucauugcuuuagccccagagucuagccuagggcuggcuuaaaacaguaacucaauauggacagccagaugcacauacuccaguuagcaugagguguuuaugaaucaaauaugcauugauacauauagcauaacaaauauauaugauuuuuuuucauacucaacaaauggguaaacugagucucacaguaguaaaaugacuuauuuaugacacauugguagcagacacugaaguucaaccugagccuuucuauacuuucucaaugaccugcuauacugauuucauucuucuccuuggaaaacuuuaugcccugaaaagagaucagggagaggcagaauaaaacagcugagucuggacuaugaggggugucucuugcugauuuuagggguuuggcagcuucugggagauuucaagagcugauugucuccacaccuggcuuaucuagcucugcucuuggaagggaauguguaacagauaccaaggugagcauuucagccaauaaaaggccccagagaguaaaccgggauuuccauauccaccuggcagagagggcugggcuggagcugaggcagcuuuccuuaaauggccuggcuuagccugugaccucaccaccuacacuccuccucgggagacacaaagaccaggacagaauggcagccacuagucuccuuccugggauggcccacaugagcccuagucacuggcaugaguaauuacagaaaguucaggaagccgggggugggaaguggguaucugaugguguaaggugauccuacagcaggcuuccauguuugcuuuucucacuguccaaggcggcuuucagcacauccuucagaauggagaagaaauggguguauuuaguccacacagguggcugccugagaacuaggucaauccaucaaauaaccaaagcccaggcccguuuguccuacagacauuauaaagcuguggaagccgggcgugguggcgcacgccuuuaaucccaguacucggggaggcagaggcaggcggauuucugaguucgaggccagccuggucuacagagugaguuccaggacagccagggcuauacagagaaacccugucucgaaaaaaaaaaaaaaaaaccaaaaaaaaaaaaaaaaaaaaaaaaaaaaaaaaaaagcuguggaagccaucaauuaaaggauuuaccagcacccuacauggauguaacuuuguguauuaauccuguagcucugaaaggcaaaggccagaucccugaaaagauugugcuuaaaaaaauaauaauaaucaacaacucuaaagaaacaacuuaaacuggacuuggugauuguuguugggaaucccagcacucaggaagcugaggcaggaggaucaccaugaauucaaggcuaaucugcgcuacacuguugaguuccacacuagccuggguuagacccugucucaaaccacagagugcuucacucugccacacauaaacuaaaauuagaacgggacagagauuagucccugaaaagaaugacacacaaacauacauauuaaauaaaaguaaaaacaaacaaacaaacaaaaacagugaaucagcuuuaaaacaagcaagaaccagcauagugguauacacuuguauccuagccccaggaaagugggagcagaaagaucacaaauucaaucauccucuacuacauagaggguugcaggccagccugaacuaccugggacccugucucaaaaaaacaaaaacaagaaauagaaaccgaagagccacagcuggugugucugcccagcacucaggaagcagaagcagaaagaucucugugaaaucaagggcagccuggucuacaacagugaaguccagcccagcuaaggcuaauagugagauccuaucucaaaaacaaacaacaaaaacccaaaacagaaaaaauaaacaaaucaaccuaacuaaaggauaugcuuggguaguggagggguuuggguuuucaguuuuuaagauucugcauuuuagaagccagagauucuacaggcaagcuuacagggcaucgggacgaugcuaacagagcucaucaaagccuguuugugaccuuuaagccaccugugucagauucucagaagccugcauaguggaaccuggagccaaggucacaauccucgguuuccccagaaggucgaaagaguguccccaccuuccuaaaugaaggcaauucauuuucaauuuucuggggugcagugugugauuucuggaaagauaccucugaucuagcgcaaucccacacuccacuggugcaauuagaccccgggugagcagugguggagucucagacuuaaagggaacuggaaccagccgcgggaagcauggaagcuugugggaugcuguguggagggugcuucucccaccuaaaccaccggcgggggcggggcucucuaccucccacugggugugcucucagcggggugaaguggcucccugccuuugggggcgggggcaaugcucucagcgggggcucucuaccucccgcggagcauguucuaucuccaucaacaccagccacucucagcucccccuacguuaagaccucuguccacagucuauuucacaauggacuguuuuccccaaaagcacacacauaucccucccucccucccucccuuccuuccuuuccacccuucucucuuucuuuccuuccuccuuccuuccuuuuuccuuguuuuuuuuuuuaaaggucucauuucacucuguagcccagguuagucuguaacccacuacuuagaccaggcugaccucaaaccuacaacuuuuagcaauccucuugccuuggccucccaagggcugaucacgaaugggaaccaccacagcugcagcucacacacuucacuuccgggagugcaggucacaggugugaccaccgcuggggcagcucacucacuucccucucuuuuguuuuguuuucauccccucucuuuuugagagaaaagaaaaccaaaaagaggaggaccagucguagaugcuucaggcuccugauuuccuugaggacuggaaugguguccacccuccagaaguucucauuuuuaccuuagguaaaugacucacucgccuuaaggggcgugagugagcaggugguacuaucaguuuuuaagugaucuugucacugauaugcaguggugugagugaccagacacuagcacguagagguguaaauuaaagcugggucagcgucaaggugacccuggaaucccagcacuggagucugaagcaggaaaaucaaacugugaauuucugaccagcccaugucacacagggacauccugucucauaaacaaacaaaucgacccaaccaacacacuggugguuaggugccuggcuaacauguaacaacaggcugaagguuucauccuuagcacugcuaccaaagacugucguaacucaggcacacauacgcaucagcaagccaccaggacuugcacugaucccuaauauauaagcauuccugucuccaagcccaccaagcucaacccugagugacacgacgucuacuuauuuauucucagacacucacugcgguccuuggaaacauccuagaacacucaugccucgcuagcccaucccaacgugccacugaaggcaggccggaugcucccugcucucagcaaccuaccagaggcucagauucguccuugggcaagagucacguggagacuggcugaaggaucccugaccauuccaaccucaggaccacagggcugcagccuuucuggacccaaagaaagcuccacaaaaccagucagaucucagaaaagcaaguuaagaccaaccagucgggccgcuauuucucuguaaggugcaccaccaaaccuggacccaacuuccaaagcucacagcaaacuuuuagacaccaucaugagugcuguagauuuuucagguggcuuacgacuggaagaagaaccucggugaaucuauucccagaaagggauugugugugacuucuccuuuuaaaauuauugcuuuuuguuuaucauacuuuggggaucaacuaaaaucaugaggggggaggucauuuuggugcaaaagaagcaccuagaaacuagggaaaauaguuaaaaaagaaacaacauuaacaaaaaccugguccucuugccuugcucccagccauucccuacaguuauacaaagaaaauucuagauuaucacaauaagaccucaauauauauugaguguuugaauguaugagucagagcuaccuuuucuuuuuuuuucuuaaagaaaacaaaaaacaaaaaaacaaaaaaacaaaacaaaaaaaaccuauuccuugggaaagcagcaccuguaucgaguauuuuuauccuuaugaacaaaaaccacaagucauuaugaaccgguuccucagugacuauaccuaaauagugggagucaaaucccgguucaaaugccugcccugcugacccugugaagucacucuaugagccuccaauugcucaucauuaaauggaacuacaguccaacuggcucuacccagcagguuuggcggucugaaaugauagaccggcuccaguaaucaguuggaggaauaccgaugaccucuaaauacccuuggcccauuucugccccguauaaauagcagagccagacauaucuaccuugaucaaccacaaucgauaaauaagacucccaaaucugccguaaauuccaaggaagaguuuuguccauuccacccuaccagcaugguagcacgauuucuuggcgccuucacuacccgaccccacucggccgaguaacaccaucaguuucccuuaccucugcccaggacauggccucucuccaggugccucuccggcaccgggaagguguagaccucggaacugaagccgggacugcaggacucaggcuccagcuccuggcaaagccaugaggagaccugggauggagguaaaguaagcaaacuggugacuugaggggguucccagcagcccacaccgaaaccaaggguaacccuucccucgccucgggcgccgggauuaguggggaggaccccccucagggcacacagggacgcuauccgcucaucccgaaaccagccgccaagcuccaaaagccuuugggggaggggacaucuggggccaccaccuggcaaccuaguccaccuuccucuccuagcuccauuugcaucucacuggagacgccuugacucuuccggacaccacuuuccuucgaccgcgaacggucucaacgcacacccgcagacuccucucggguaccccaaucuacggucccucccuaacaggacaggugcuuuuauaauacuaaaaucccuucccuuaucucggaucguccgcgcuacuucagcaccccaccuucuacaggcaggcccccauccugcuccacgccuccucugucucaaacagggacccugcucaacccggggacccgggagccggcagcguggcgcgcccccaccugggaaccugcgccagaggcgaccacuccgcgcccgccuggaccucccucccacuccaccgcacucagccccgcaccgcgcagcgcccagggcgaucuggcccuccggaucccaacuuucuuggaagaagggaagcgggaccacagccggcagaaaaacacagcgaagcggaucauggggcacgagucaggacccuccacauaccugcagcaggagcaggagcgcggaaaagcugcggcaccgggcucccauggcggacccggcagacgccgagcaaacacugagcucgggugcggucgggcagggccggguuaggccgggcaggagucuagcagaaguucuugggaacucaguagugcgccgcggcucccacaccagug

SEQ ID NO: 12426 - RNA, 150704 nt, Mus musculus
ccuauuuuuaccaaaagugaacaugucaccaguucuucucaaagagcagggaauaagcaccaaguuacgagguugaugucgcaugaaaggcaucaucaguauuggacacuuuguccccuucggguaugaauuugaauuccauggaggacuuaaaucguccaugugacccugccucuagaauguuacuugggaauauguuucaaguuguuaauuucagucuuggagacucauucuaggcagaauauacuugaaaucaaauaaaaacaacaacacacaaaaauaaaaaacauaagaugaagcuugccaguccagcagcaagcgcccacugagcaccauuuggugucaagaguuugacacaagagauuccaagcaacuguuaggcagaauuccaucccuguaugcgauggcucugagucucaguccuugaccugaaugagaccuuacagacucuguuaaaaauagaugucuuugcuguugaauccuuugauguucaagaguacauaugugggaacaagaccugucccaaagucaacgaaguucccacuuugucaaaaugaaaacuugacuuaucucaguacaauccaucucucgucuucugaaucacagugcaaaccaaaggcuauuuuuuuuuucuuaguuagauuugucgucgcuucucauugucaagugcuuuagaguaccauguguuuccaggggucaacuaagaaggagaguggcuaucuguccauucuuuaaacccuaugggauuuccucugugguuuguagucuugauacgaagaccuagagauggacggguaaggucuuggucugaggagggugaggagaccccaagaucagcucuuccuugugcaugaucuacagcacugcuuuccauaaaauuugugguugcagacuccgugcugagggaccaggugacaccagcugaagaaauccacgcaagaugggucaucugaaaggacagaaaacauucagccuaguggcuaaggcuuucggccuucuuauuaagaugagggccuacagaacagagaccuaguaggcccacugccuuguuccuccauguguucugcccaugauauguuugggcuuugucagggcaggauuaagaugucaaaagggacugugucaguuagcaaaauuuaaacaagggggggggguaguguuagaaaaaccaaaagccauacccaauaggaggacaugccuauuugucugaauauaaccuggcaguuagugcagauauagugucccagggaaguaccuucuaaaggaacauuucuuaguugcucuccucuugccuuuggauauacaguaaagacccacagcucuccugacuccuuuggugugggccccagcuuuguauucucucugugacucacacccgccuacaguuccuuaaguccuggguucuugaauccuuucaugccuuuccccauuucccaggaaucccuuucagacacaaaccaguuccccugagccagucuuuccaucccuaaaucguccaagguauggugauugcuguggaggcugaagcuuuaggaccugaagccugccucccugacucuccaaccacuccucucuuuccagacucaaccacacuaggcucuuugcugaugagcgaugcagcagugagcuuuuaacuaccacuguccccuuuacugccaggcagacugucccuaacauuucagguuaguuucuucuucuucucucucucucugcccacacaacaaaccaguccaccacuuguccuugcugggaggguucucgcucuuuucuuugcuuucuauacucaaguuacccaccuucaacaccgcaugguugcuaacucuaucuguccucuagaaggcaaaagcuuugugaccagaaucuuggucuugacuccucauugguuucuuuccccauacuuaaaauagugccaaucacaaagcaguuccuagaucaguauuuuucuuaaaguuaccaaugauuuuuagacuuagaacacuauugucacuuugugguggcuugagcacuaugcuccucccagguuucaaaguucauucugaacaauaagcucuggguagcaaaagauuuaguuuuguacuuauuaaguccuaucccucagcucaacagaaauacgaguguugucuaaauuuuucuuuuuuggaaaaauuaaccacaguggcuaaaauaaucaaauuaaagcauaugguacaggaacuuagguuuaaaagugaggugggaauauucuuuucuuuccagugacuucuagagauacacacuaaacucaguguugauaacuuuuaccugcuaguaaaugauaugagagaaauaacaauaacaacaauauuuuuuaaaucaguauauggaagaauggaauuuaauucccugaaauggacauuccuacagguugggcauugggcaccagaaacaugguuugcuauauacuaacaagguucaugauucaagucagacauuaagaugaagauucaaguauauuccauuugccuaauguauauguauguacauacaccgacacacauacaggaguucaauuauuauauaugugucuaccucugaugccccagaucagauagcauguaucucuguaccauuaaucauucuauuuauacucuagauuauucuguuggcacaauggaaguuuuagaagauaauauaggccacuggaacuaugguccuaccuugauggucaccuaucuuuguguucuuuugaaagaugguccuuauacaucaggauagcuuugaacuuguagguauguuuuugccucugccuccuaaguguugugauuauaggcacauauuaccauuuuuugacuaaccucaccaugguaacucuccccucacuuuaaaaacauucuaaaauuaugugugagugcucuuucuagaugugacuacacaccacaugcauacaauacccauagaggccagaaggugacaucagauucccugaaacuggaguuucaugauuauuaacugucaugugggugcugggaauugaaucugauccuuuggaagagcaucuggugcuuuuaaccacugagccaucucuccuaugaacagaauggaauuuuaacacaagcauauaucuggggccaugggcuucauguagacaagaaggcagagugagaacggucaacaugcuauguguguauggucccuucuuugcuucgugaauguuugaugauaaggacaguuaugaaugacuggguaucugagauaugaaccaggcuuacauuguggaggcugauguaagagcccucucuauuuggcucucuccaugcaugcugaaaagcagcaagcaccauuggcuaagucuucaaaauccacccagcaucccaccuuccuuagaaacuccuccaucucuccuuggauagcagcagcuaccucuccaugaggagauccuguucucauucuacuccaggugacccauggucaugaucuuacagaccccaugguuuucuuccuuaacuggcuaaaucugguguuucugugaugaccgauaaggcaccuugugccacuguugguuugugccucuacaguccucaacugugcuucuacucugaguaucuuucuguuccuuuguauuugcccuuuccucugcuaaacaaaugcaaggccugccuuuccuacucccuggaggcccucuuugaaaguugcuuucaauucugacaucugacuugaccauucugucaaucugguuuccccaucucuuucucaauguggcuauuuguuguggugucucccacaaggcucuguaaucauuaauagcuucagaauaggacccugcuugcuauauucuuuuacacaaugggaguccugaggauacaagguaaguucuuagugaccuugauaugaacagacgcaaggggccucaccauaccauacauacauaccauuguucauuuacugcauacuuaguggccuuugugagccagggaaguaucagaugcuagcaaaacaacacuagcacgauuuugccucucacgugccugucugagaggugcuaccaggacuagccagaguacuaaggggucacauuuucuucuagggcgaucugacuacaggcuauagacaggguggagauggggucuggcagaaugugcccugucacucuaaaauacuaaaauccccuccaagcagaaucccaguaucagaugagccuguuucagcagccucuauaucccagucacucagccucagguaggaaagaggaggcaagaauacugauguccugagccaccaauccacugcagcugagacaggaagugaugcaggaggacuggcagggcagagggagggcuaacugacagcaccaaguauuauucaccacagauuggacaaaaugggcugagugauucggcaggcuuggaaaaccugugauugggugaaacagaaaagaaauccuagcaguugugugcggaggaaagacucugaucugucugacagauaugucccaguguuugcuggacuacuauaaaauggcuuggauugcuaagcaugccucugaauuacccaucagcacccucugcccugcacuugaaccaacuaagaacaccaucauuuuaauggguuguaaguucccugucuugccaguggaaaugugagcuccuucgggggaaauuugguuuaccuuaauuuuugcuaaccaguacaaauauaaccuuuuuugagggagggucucauguagccaaggaugacucuaauccuccugacuucaccuccuaaaggcuagaauuacgggugugcacaguuaugccuaguuuuuugucaugcuggaauggaacacagggaucugugcaugcuaggcgcgcacgccaccaacuaaacuacaucucacaccccagauauuucgucuuaaaaaggaagaguggugcuaugacccgagauggagucacugaaaaacuucacugagugaacugcugccuucagaucaugcaaacaauaugguguugacgagaacggccccagaguugggcuugcacaaggguaagcacgcaguccccuggaugcugauuggcaucagggugccauagaguugugcaagguacaagcugcacagccaacuguaaugagcugugggagaguuuucuucaaacuggugaagguaauggggcaaagaaucccuuaccuuucuuuucaggagcuggacagaaguugguguuacaggcucugagcaccggaggcuucugauggagcagacaacuugaggaaggccggccuugcugcaugcaguggacagagcgagucuggacuccucccccgcagguuacugugcacugccagagagagagagagagagagagagagagagagagagagagagagagagagagagagagauaguucagcugaguucagcuggacagcauccuuucugaggucggcggcaucaaacagacggaagcacaauauucaggaccaagaugccugcagccaggucuaggcauacaggccaagucuauucagcccagugugaacuguguggucuaucagaaaaaucuugaacaaaggcuauuguaucaccugagaguauguguccccaguuaaaggguucaacaggagguaggcuccagaaauguuuuaaaaacucagaaacaaauucagacaugaccagggauggagucccagaaacccaggcaaccucagucaaaugccagaauggaugggguuaguuugaaacagggaccauaaaggacauacacuuugggaugguguucagucagguuuugagguagcauaguaucuaacagccagggauuuuuacuguccaauuaaaaagaaucuaggcucugaguuucucuuuguccucaacggcuacaggaagaauugauggaucuucagcagaaggacagacaaggacauacugggggaggggcaacacugucaauggaucauugcucuguugcuuuacaauggacugcaggcagcugacagcaucauuucguacaaauacugcucuguggccugguguuugggaggaaagaggaugcaguuaggaaucaucccaacauucaaauacagacguaugauuuccaccaaauuguauguauguauauauagcauuuagguguaaugucagccuuuauuauacaaaaacaggugucugaggugggaaacaucuggcuuccugguauuuguuggcugacuucugacuauauuuacuuguucagauaaaagcauaugauuccccuguguaaaaaugucuucauaauaauuacauguaguaguguguuucacaaaccauaaaaaagaauuuguaaagguuaaauaaaauuacaaaauuuaagaagccuaugacucucucuguguguguguguguguguguguguguuuuaccaugcccaguugauuaaacauauucaauccccuuauauuggugauuaauucucaggucccgcuuuguaccuuucaauguuauacacaggugccaccaggguguggugagcagcuucagucauauuagugagugcugcagucucaaugucucaaggaccucaacauagcuuccaguucuuaaggaacccaacuagugaccccaagaaaauaucagcucuaucagcugauggcugaacauucuugcccuuaccuuccuuguccacaaaauugugacaauaaugguuaacacaagaaauaaugcaaauauggaaugagaaaguacauguagaccaugaacagaaagcacaggcaggggcuggcaaaauuuaggguauguccuuuggaaacaugcugcucuagcagccaggaaguacaggcaaaagcagcaucccagaagugaugguuucaaauggcaggaauuagcaguugcugugagcacacugucacaggcuuucuauucaaugcuuuauucauuuuuccaauuuucuaggucuaaaauuaugguugcuuauagacugugguaccugcccaggcucauauagaaagagugggauagcucaaaugaugccaaccaucccaacucuacacagugggacaacgguugaugggcuaaggacaauaccccucugcucuaucucacuugaccaucugccuccuaaauugccugcaccaaccuguugccauggugaugaauaccagcucgccaccgccaugcuguacacugggcaaguccuuugguugcaggcuucuuccaguuccaggcuuggcuucuuaauguugcggcaucuccgcuccgggaauguuauuaguuuccccugcaaggucuucucaacgcauuucaguucucucuuccucacacccaagccacagguugcagaacacuaggagcccagaaaggagcugucagagcgcacucagagcuccacaucaaaucugcugagcugcauagccacacagugucaaugacaugucaagucccuccgcuuacagaggaggaaaucaaagggcggagcauugaagugauuuuucucugaguuacgaagagagaucccuguugaucaggaaggaugaggucacugguuuacucacucugucaaggcccuguauauuaucuuguaauaauuuaaaauacucuugauuuugccccagccuccauccuuggagcuggguuuguacuggaguggcaaagacuacuugagaccucucugaggaguggagaguuugagccauagaaugaaaaugaucgagucggaaccauuuuagauggaauaacugccuaccuuuauauuuauugguguccacguugguuagaugucaccucgugcuucuccacaccacauguuccaguucccaaauaaugacucagaggcuuuuuuuuuuaugaacaaauauguaggcuauaagcuuuggucauuccauggcuaaugcauaacuuacauaacccguuuaaacuauucuaugucugccaccaggcuaguuaccucuccucaguuuuauagguccaacuuccucagagucugggugaaucaccugccucugauuaucucccagaguuccuauuuuucuccuagaacuguuauuucuugccuuuugcuaauaggcucccagcuuuuuauugacuggcaaugcacuacacacugcacaacagcuauuaucccagcaguuagaucuauucuaaccguguguuacaccagggagggaaagagagaaaucugaaagagaacagacuguuuuaaacuauuaggcaguguacagggucuugauaaagugaacauuucaauacaccaguauaaauauuauaaaauauggcggugauauguuagcuccauuguaaagaugaagaagcaggagcuagcucaauguuaccugcauggugcauauugauggcugguagcaaagagggcacauuuuucauuuggcuauuuuacaguaaugcuucuauaaaaugauggagagaagacagggguacuguaggauugcauucaugaugcagccagugcguaauacguaagaacagaaguauauuguaggaacagauguguggccaccaagcuccuuuauaguaggugaugcucacugucagguuuagaaacuagauucaaaacaaccaagaacauggaguuuccagagcgguuguaaugaagugggaagauccacauuaaauguaggugcugcuaccacaugcguugggcuccugcacuggguaaagugagaauuugauaaagcucauagaacacaagcaaucaucucuuuacauuuuguaaccauggaaacaaacaagaaacagcaauagauaagcaccuggcacauguaugcacagaaaggagccaugugagugugggugagagaggaagcaauuauaaaaauacccauacccgcccccccaguugugugccuaaacucauaccucacuccaugcagaggcaauccacuggagccuguuguuuuuggggcaccgucccagcacacagcccuccugugccucgggucuggggcugcuggagcacaggcucucggggagugucuccgcugcagggcuuuuacaaaggaccucacgccuccucacgccucguccacaggucuuggaacacuugagaagaaggagaagagaugccauuugcacccauuucagauggauuucaguuggauaaacacugagaauauaguaauggaauuguuagcucccucuugaaacaucugaguacccgaggaugcuagaugagucuaccagucugaaaugaauuaaacucaucauugcaaaguuuuuuuuuuuuuuuuuccaggcacaggauauguuguaccagaacuugucuuccucuauuugccaugggaauuugucuaaggaauauuacugugccagcucagaaugcacaguagaaauauguacacucucuuagugaggaugugaaugacagugucaagaagagcaaaauucuuacuccuaagaacuugcccugggcauggggcauggcgcuuacuaccagacagaggauacaugcacuuauaaauauuucugaagaacuuugcuuaaucuaaaucacuacccugggaacuuuacuuauuuucuucuaagaacuuucuauuuugacuuuccugggaauucuguaaaccagauaagauggcaaaaaaauuucccuggagcagcuaaaaacuuuucaugaucucuuagaaaacuggucccacacagggacugucuuggagggcucuaacacuguguugaucuuugggguccucuuuuucucucaaaccaaaugagauguggccucugguaccuaaauaauaggcuggggcagaguccuacaugggcuuagggaccacuguaaauucucauucaucucauggcuaguacaucccgugacagcuggaacuuugcaauauacgcagcaugauagauuuuggguuacaaauuggcccacguaucauacaacuguccaucaacuuucugaguucauugcuaucauccucuucaaaggaaacgcuugaggauugaagcccggguaguuagcuguuaagaaacagacacgagcugauaagugaguuggaaaccugagccauggaacuuaucacugcucucucauguauaauuucugagcaguuaauaaaaucuuaauuuuguuugcaauauuuucagaagaacaaacuauauccauugguugaaaaggaaauugauuuguugcugugacccgugucuaagagcugaacagcuuggggaaaugaauucuguuucauguucauccugaaacuacucaagacaggucuggucuuuccaauucaacuuuaaaaagagaagaucauucaaaguauuuccaugugaaagcuugaguacuuuaagaugugcuggacacucugcagcauccauuuagguugguccaugcccaucauacacaaggggcuccaucagcccucuuccauuugcaauucucauuugagaagaaacauugauuccacaccacauuuuacuaagauuuacuccacgcuauaaacaaauguuuuccucuuuuuugcauggguccauucuuauguucaauauauuccugccuccucuuauauccuuguucccuacaaaguacauucuuacuuugauuaaaaaucuuccccuagucucucuggggaauuugguggugcauuguuaaacuugggaagaaauacacuuccuuugggagagaacagaauuuaagggaaagcacagcagacaagggaccauuugccacuaacuagcaucauggugcaugccuuaucccacacuuaucucaccuuagccaccuacacaggcuaagaugagaugcugaagguagggaaauccugguacuuguccuguguuguggggaccucucugggccccagaggauguuugccucuguguucuagaggccaguagggcccauucacuuccaagcacgucucugaacaugcucccagaagaagauaucugcuuuacaggacauuuaugaggugugcagaguaggcaguuccuacccuuugccucuucugccccauugaugcuaucuaugccucaugacaacugcaaaccgggugccauuucuuauguauucuuuuagcucuaugucauugccacugaagcaaaaaucacaucuuuuuccuuuaucuuguucucuguguccccucucauucauucauucauucauucauucauucauucauucuguaugcauagaggucaguugauaacuuacaggaauuguguggguaccgggguuuguucucacgugcugggccugguggcaagugccuuacuuguggauccauaucucuagucgccaggacugaacuccaauccccuucuaucuguauucauaggcugcucuaaauagucuccaugcuaauuucuggacuacuaaggaagagucuuagcucugguauaagagguccaagacuuccagccagauaagaaccacuaaacugguacuagcugaaaugaagauucccaggcacugcccuauuaacucaccaugcacauugcugagcgccccgccggcugcaaaguuaccuguacuuccaccaccuugguuguucgugcagaccaaaaccaguguuuucaaagcaguacuaguuaccugagaccaggggcuggggcuccacucuggagggcaggcauggcuguugcagacuugaaccugagugggcgugcucacuggacagagggagugcagcacggccuccucuuucuggaagggcuucuucugcacacaccguaucuugcggcucugcuggccgccggcacaggacuugcugcaugcgcuccacuccccuggcaaccaacuuucagaggggaccaaaauuacuuccuguagagucaaggcuugacaguaccacucaagcagcuauugggaaagacuuaaccaccuaggaaaagccucugauccuauuuauaaccaaucggggccacacccacuaacuguucuuuuauggcuguuggaucagacacccauugggagagcaggcaugcuguaaggaggcacauuuaaucaccaugagguucuggaaaacaaaauaugcauccuagccuagcaauacauucuguccucucaacaauucauccaagcaaauugacugagcuuuuaacuaugugucagggaccuacccucugggguuggaaagaugagugaggucaccagucuuuccauaagagagcccuacaacacagugacgccauggauaugugcaucaagacaaggcuggcugauaagcagugacccagauugaccaaaguacaaccacaaggcuaguggaaguguaagcagaaggaggggugagugggagagguaacacuucagaggaggaggcucugggaagcucacucuaagugagcagcuccucacaugccuauucuaguuggccuuacaacuuacugauggggcagagaucucaccucacaucauuuauuuaaagauggccagauaagguuuuccagaacuaucuuaagucguaaugcauggaugcccaucuaugggaacaauggcuccuuuucaagacuuccuucugacugauugaaacacuaugauuuacagauauuaaaaagagccaguagauauggcugcuacacaucugacuugcagugaugaugucuacaaguuacccuggauauggauaugcaagugcugauuauuuuuagaaaagaagaccaaauaaguagcucacugugcuguguuuagacuucuacaauuucauuaccuuccuuaaucuuauuucuuccuuuugucugguuuucaccuguacugguuugaauauucuuggcccagggaguggcacuacuuggagguauggucuuguuggaggaagugggucacugugggcaugggcuuuaagacccucauccuagcugccuggaagccagucagaacaagauguagaacucucagauccuucugcaccaugccugucuggggcuaccauguuccugccuugaugauaauggacugaaccucugaaccugcaagccagcuccauuuaaauguuaucuuuauaagaguugccuuggucauggugucuguucacaggaguaaaacccuaacuaagauaccauggcacaucugugugaaauuaaagcccuucagucuacagagucaagcagaaaauccacaccauccuguuuuuaagucaccaacaauguaucuaauaaaauaauuccucauauuuauauacuuuuuguaccuuacaauauuuuuaaaaauuaguaugaaauugcuaguuucaccacuugccuacaugaauugugcuuuuucuguuaaacucaaauucuugccuuuugugggaaauaggaugaguuauacauaaacugagaagagcaucgcacagggacuuuuggguggcacaccuggccucccaugauuggcucccaggcuacauuuucaacugacuucauugucaucuacuucuaccgaaggcacagacaucauguuguccauuucaucucuuacugccuaauacuuagugucuuacagcacagggcuuugcaucucaguccuuugugcugauccaucauuucuguucucccauggaagguuguugcugaugacugggacuguauccugucacccccuauaccacaaugcucaguucagagccugauggacagugaguccugaugaugcgcuucaugcagaaaaaguaacagaagcugaucagggugguucccuuguccccaagcuucucagaguccagagccgccuuucuaaucuaugcuuggagaagagcaagucuccuaauugaauguauugacacugagcaagggcagagaacagagagagagagagagggcagaggagcccaccugugacaccagcuucccucugcagacccugaaagggguugcucugauuccagacaacaagcuuguucuucccagaacagcacacggguuucaguggacuccagaaguucuaguuguucuagaacuagaaguucuaguucagcaugcuccuugccuagagauaugugucaaagagucccuuucucuugcuagguggucuaacuggugauaggaggaauaauaucaucuugccaaucaguguuaugauucucuauguauacauuaguacacauacuauacccaguuccccuaaagaacagaugaacucaggauagucaagaacauuuucuguuaaaugcaucaugggaaaaaaaggaaagucuacagaagcccucuccccaugcccucuucucuuuauagacauaaucagcuucagaaucugagagaaucugggcuugcaggauuguuggguauuugaaaccccaaauaauuauaggaaaaugaaauauuauauauauauauauacauauguauauauauauauauauauauauauaugcauacacauguggaagcacacacacacaacaccgugucacuuacuaaaaugaugugugcaacccugaugacuucacuagugcuuuauagaaguauauuugguuuaagauaaaucagcuaagaagggacuccaguuggccgggaagauugcuuagauucaucuuccaacaguaacauggcuaaaaugagugugagaacacgccccacccccacccccacccccacccccugugugccccggaggaggcauccaugggggagucaccacuuggccuucaccucuccagcuugcaugugacuacugugcaauuuguaucuuugauuuccugggcuucauuacugucauucugcguucuuggaugaccuauguaaaagucaggcaacacucaccuugaacuaauacaggguugugugucaguuaaauaucugcuugauuacacucuggaaagaggauguucucuucaaaaguuaaaauggggggugggggucuguggcuauggcucaguuaucgagcacuugcuugguaagcaugagacccuggguccaacucuuacuacugcuggaggaagaaaaacugucuuuauacaucaagcuuccagagcaaaacauaaguaaguaucuaauaugucuaauucauauuuuuaggucucgugauccaacuucagccguuuuucuuuuccggauuuuuuuuuuaaaaaaaauauuguguuuauauuugaaucccuuccaacugaaaguaugggcagggggcuuuucauuaugucucaccaguaaccaaguuguaggagaacacauacaagcaaggagacauuugcagacgacuuacuaggcugggcaggagaaagcguugcauaucuugggcucuguugcuggcuugguucuuacacugcagaaugaggaauugacuuggguguguugaucucguaagcaaauggccuugaugcuuauauaaccuaguaagacaccagaaguuacacagugaggcacacagacaacccauuucauuuaguuucccagcuuaguuuggggucaaucagcauucugguaucccacuuaagacacggaauccacauauuuugugaaaaugguucccuuggauacaauuucaacccauuggaauuccauuuauuccccaagauaauaauagauuuuauacuuuaguaauuuuaauauaugcuuuuaauuuucaaguggacucuagaaccaucaagugauagauacuauuugaaacagaauaacuauaaaaugaaacgucccaggaaucuuggacauacauuguacaggucuaaauggaaaguauuuauaucaauaaaacaguagugagagaccggagagauggcuuagcgguuaucuuucucuugccucuagaggguuugauucccagcauccauacagcagcucugcaaggccaucuacaaagccaguuccagacaguucugguguccucuccugcccucuguggacacugcccacauguaggacacauacauacagaucagcaaaacacuuccacauguaauaauuaagccacuagugaaguauaugugaaaaccuuaauaugcuacuucaccaugaggugauggaaauguagguaaaagguuaaacucugaauauccacucauaccuaccagcuuaugacuggucuguguaaauauuucuuuuagcggaaccauauggauugguucccaguauuuaaaauuccccaccagaggcacacauuucuuuguaaauacucauguuuagccuccagauagggagcauggcuugacuuugaauuguuccuuguuuuucauuuauaugguuuuuuuccccuugaaacagcaucugagacaugauucauacaucauucuccuuucaugauugacaaucagcugcauuucucagcuaaaaaaauuuguuuccuagagacauggaucuaaagugcccugcgguucccgagaguucacgguguccuuccauggccgggaucaaaccuguaagcagggaugagcggggaagcagggcaggaagccaguuaccuccaccgcaggugacugagcagucagacugcacugugcgccagguguggugguaucucuugguggcuggcugaguuacauucaugaccuugggaagugcauacuuccaagcgauccccggauucuugccuugugucagaaucugcauaaggugagauaaaacguaagaggucagcauaccagccagacugcacaaaccuuguugaccauuuuaaagauauaugucauuuugguccuaaagucaggucauuucuuggucucaagaauguuacauggaggagcuagagacaguacccaagaauguuacauggaggagcuagagacaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacagggaacgccagggccaaaaaaaaugggaauggguggguagggaagugggggggggaggguaugggggacuuuggggauagcauuguaaauguaauugaggaaaauauguaauaaaaaaaaaagaaagacucaaggacaccaaugaauacggcccaagaagaagaagaaucagaaagggaaaguggucaccagacagccuaugagaagucaucgcaggacaagauccaccucaccacagcugaguggcacccuucuucaaucacacagaaaucuagccagaaagacaacuccccauguugggauggguagucuccucccaccugcaugcauucuucccagucaacagcagcuaguaugcuuuugaagugugaaauggcaacauagcuuucaauuucaaaauguaucgauacucagugggaauagucaagucacuguguguccuuuaugguguuuucuuuuugacccagugauucguuuucuuacuaauagucuuauaggucagaaauaaaguaucuagcuagaugaaaaaaaaaauaagaauguuacauaauaauuuuuuuuaaaaggcuuccugugacaguuuaaacuauuagauuugcuaggaucaaaacuggaguagauagaugcggagaaacccaauuuggugcuuucuguaaucacauaaaaguaaagguaucaauauugauaaagcaaaugagucuuuacaaugaagacuaaugcaucagcaggauggcucagcagcugcaggcgugauccugacggccuaaaugcaucccugggagaugcaugaugguagaaggggagaacagaaucuacaacguuacccuuggaccuccaccgcucaugcccacaugagagugugugugcauacaugugcacacauacacacacacacacacacacaacacacacaacacacacacacacacacaaauaauacagucaagaaaugucauaucauugggucucaaccuuaagcaacacacacacauuaguguuccauggguaauaguuagacucgaugagaaugucucuauacugauuauaaacugaccuauaaaccuuuaugauugaagcccagcacagaauaagcaugccuucaaauuauaguauauccuagucugaguuaucugucccuacuguacagcccaaguaggguucugauagaaucuucaaagaugguuugcaaagagaaaguaucuacauacgaugucuaaauggaacggucacauggacuggauagauggcuuagugguuauaaacauaugucaccuuugcacaaaacccugauucaguccccagcauccuugcuggguggcucauaaccgccuguaacuaacuacaacuucaagggaaucaauauacacaucuggccucuucaggcaccugcauuugugugugcaaacacauaaaugcacaggcaaagacacagacaugcacacaaacacacacacacacacacauacaaacacauucacacauaucuauauaaaguaaaucccaauagagucaauauaguauguaguaugagggauuuaaucuaaaaucugggccaggacucagggcuaaucugaccccaugcauaugcugccuggugagcuguggucugugggucuccuuugugaucagguguucugccagcauuuucuguauaauaucucagaacaucuaacaacucuacaaugccuucuuuuuuucuccauuaaaagaauauauguacaugaucaugcaaaugacuagauuuaaauaaaaucugcaaaaaaagaaaaaagaaaaagaaaagaaaggaagaaagaaagacagacagacagacuguacuuuuccaaugccgucucuaaccuucuuuuugaugugggcaaacacucucuggguguccucucucuuaagccauucccuuuuuuuucucucucucucaagcucaauucaugaauauaaauaacugguuuucuucuaccucaugagucuuguggaaaauucuucaccaccagaacugggcaggcacacuccagaggcaaaggcuacagccaguuaaaaauaggaaccccuggucucugucuguugcgaucccaccucaauuaaaguuggcuugggugguacuguaccgcugugccacacuggucuuuggcaugcuaccacaaggguuucauauugcugguagcuuaaaugucuccagaaguauugucuaccacugaagggagcauggugugagcaucacgugguaguauaaccaaaccaaucauggaaucuucuagacagagucacaucaacagaugguacuguauuaaccccaucacuacacuuuaucagaaaugaaacugauacuccacacaacaggaagaaccauuagcaugaacuaacucagauucucaccagcugccaauaaaaauguccuacucuccuuguuuggccuuucuuucuguguuccugcaaucuucuggugucagauuaaguaaauucaggcaagucacagucaaacuagaauuugaagagcagaucuauauucagaaacuuugauggcuuuguuuuguguacucaacccaacccaaaaucaccugcaaagagagucucagugagggacugccuggaccagguuggccugugugcaagucugucuguaugaguguauguuuguguguauauguaaauguguguguauguguauguauauguguguguauguauauauguguguguauuuguguauauauauguguguauauuuauguauauauauguguauauauauguauauauguauguauguaugugugugugugugugugucuuggguggggagguuauuuugagugcgcugauauagaaaaagacccagcuuaauaguagagagcaccauucccuggcaguggauccuugacgauauaagaauagaaaguguuagcuaacacuaaucaggauacauuuauuccuuuugcucuugacuguagauaugaccaguugcuuuggcuuccuguuuugcuuuuuauccaucagggaagggcuauaaucuugaacuaugaucuaaaaccacuuucucccuaugcugcucccacccacccacccagaguauuuaucagagcaacaggaaugaagccaggacaggaggugaucuugcucuuuacugauauuucacccuaccugcucuucagcuaaagcagguugacaaaucuuaacacucucgguugccacugucuauguguaacagaggaccugugagaugcagaagagauauggcaagccaaggaaggccuuagcaaggugaugcuacaguauggugguagacucacaaucagcuguacauagcagaggcaagugccugugugcucuggaggaaaaaaaaaaugugcugacuuaucucuacuuucuaugccgccaaaccuuuauucaaacuaauuacugauguuuacugcuacaagugaagggaccucuacgaaaauacaaagaaaauagaaauacaaacuaauguuuuuguuuguuuguuuguuuguuuguuuguuuuaagcugcaagggugaccacuuuggugagcugaguaguuuaacagggguuugggauuuagauuccugguaugguagagagcacuugcuaagcaaguacaaaccccugaguuugcucuguaacugggaaagcaagcaagcaaggaagcaagcaaggggcuagaauguagaacagguacaaggguuuuugccuagcauccauaaaccuuggguucaggcccaggacugcauuaucaaggcccacguaauaccagcacuugggaggugaagguaggaugcucaggaaguucagacucaucccuggcuacagagugaguuugaggccacccugccugcccugcccccaaaucaaucuaaaggggaaaaaugguuugacaacuuuccauugagcauacauaguaucuguuauuuucacuuuuuagauauccuuucagaagcuaauguaacacauggcuucccagcaacacugaaaaguuagacugaaaagaaaagcuuccuucuacacuaagaaccaaacaaccaagaugcccacauuucccagacugccaucucagcugauuacucaacauaaucaacacugugacugcaggaagagacuuccccggugucccucagaagccuguuucugucucugcagcccacuccuccccgacaucucuacgauggcucugccuagccccugucucagaccucuucccccaucacauuccaguuugccuuucuguugcugugauccacaccacgaccgaaagcaacuuggagacgaaaggguuuguuggacuuccauguccaugugucugucauugagggggucggagcaggcgcuuaagagggaacugaaguagacacuauggaggaacaucgcuagugacucacuggcuuggucagcuagccagaaaacagcccaggucauuaguaacuucaaacauaaaucaggccaauuucaaccuaucgcgagugacuagugguagccauucucugugaaaucugaagaaauguggagacaucugucuaacccacuguucuuucagccuccgaaucugaguauuugggaggaaggcucaaguccaacguuagauacgaucucuuuuccuguaugcagaaaggcuacucuucacucauccuucuccugcccucgagauggcagccucgagauggcagcccauccuuugacauuuacaacauggacccacacacaccagacucuugauucuaacaacacucacgcagcaggccagggugaggugugcccuucacauuaaugugccauccgucccgccgccucucgugucacccacacugagcuaagcaccacugugucauuucugacuuccacagacagggaggagaaaugucaucuucuccagcagggaaagguaaagcagauccacgggucagaguaagucugccauggucacgcccaaaauuaaaagucaagugcuugaaaaccuacagagggaaaucacacauauauaugaaacuuagggguaauugaaagacuaucuaaaaucccaugaccacuagguaacugaggguagccaggaaugccugauccuccugacugucuccccagggcugcaguuguuuuguuuaagaaauggaacuggacuacauagagagccugccugaauuugugauccugcugucucugccucuugaaugccaggauuccagguguguagcgugaagcccagauguaguuaucaaaauaucuuggcaaggacuugagccaugugucaaaaugaacaaaaggggacuuauacuuuucugaggcuuuauagcgacaaaaaacaaaaaaaccaaacauuucccaucucuccuucuuucucacuuaaugggaaauauggaaaaguccuuugaaaaguaaaauauuugagcuaagaacacugaauaggauauuuaaaagcuauaaugaccauauaacccauaagaugaaacaagaaaagaaagaaaggagagaaggaaggaagaaagaaagaaaggaggaaaggaaggaaggaaagaagaaagagagagagaaagaaagagagagagagaaaggaagauuaaaaggcacaauguauugaaaauuuucacaggaaacacgcagucuuaagucaguaagucacaacucccuauaaugaccuucuguauacauucuauuacuuuuauagacacuagcacacaagacacauucuuuauauuuauuuguggaacacgugaguguauuuuugcaaaggcauuaagugaauuaaaagcaccccacguuuaaaaaccuaagacccgaccuugcuguccgcauagcuauaaaucuacgugcaguuauaugagcagucauguguguuaaaagcaaauacauaaaccagaggagaacaugcugaauacuuuaacgugagcccuuaaaagccuucugaaagcagaaccgacuucuacaggcagcagggcgaagcacauaaacuccaggcacacaaagacugaccuuaggcacugucugcccuuuuauuuauccuguguggggaggagaauggcagaagauggagcacacagaggaggaaccuccccucuuguguuugcugcuucauacuguucucuggaaauagacugugcacuuugucuaagguaauuucuauagguucuucuuauuuccaaaaaccugaguuuggugaagaacuuaguuucccauuucagcaucugugaucccagagcaaaagagaaacccaaggucccuugauuuaaagaagaaccuagcacuccaguaaaccaaauauagggcuccauuuuaaaaacacaaguuuuucugcuaccauuuaggacccaauggcugugaagccagcucaaaccaaacuuaaucaauuuaaagaaacaacuugaaaacuuucaaguccauaauggucauuugauuuacaguuucagucuucauagugggagaccacaggucugugaccuugucaaugacacccaaggauuucaaugugaccaucauaaucccgugaacugcacauaagcacugugaagcacagggacuuuggagagauguucaagggcccacuuccucuaugaaugauucagacaauaaaccuccugaaaaugauaaugucagucacccacaacuauuaaaaaaccuuccccaugacuccaucaacaaugacgaguugcucugcacagucacucucccaaugccgcaggcuucgcguccuugcugugguggcagcucauugcauuacagcgaugccacuucugaaccgcccagcguugcacggcaggcugaacagccaagcuguuaaaugugcaaauuuggaaagacggccagugauucagucuacuuaacuggauuuaguccagagaacuuuccagccaacggggauugggucucuaauuuacagcuggcaagcgaccccguuaaauacuuccagguccuuaauagaacuguuuaaugucuaccuuuaacacaagaaccaccugccuucagacacagcacucugcaguuuugaccgcagggugcacaguuauaaaagucacagccucuuaagguagaaaaccacagaggagacgggaaccuaccagcugcccucugcaguggggggagcagcuucugccaagggcacccaagacaguauuagguagauaacuggcuuuuaaaaaaauuucugcuuuuuaguuucuguuaaaauucacacauuucuucuacgaggauuauaucggcuucauuauugaaaguguaguuuuuuuaaacaagugcauauguuuucuaaauugucucauggaaauccaacuugacagauagguuuuaaagacuggcuucuacugugauaucaugguucuuguuuuccauuguguacuugauugcguguguuccuaaguguggguuugggaaagugccuguagaggcuagaauuaaaccuuggguguucuuccccgguacucucuaccucguuccucgggacccugugguucucucauugacccggagcuccuaguuuaucaauuaggauaaacuagcuggcaggugaaccccaacaucccccgucuccacuuccauggugcugcuaucacaccuagcuuuuuaugucaauucugggcccccaacuugggucaucacacagguacagcaagcauuuuaucaauggaccagcucccuaguucccuagugagcuugguugcuuucaacauagugagagcaaugucucuugaguauaucuuguaccccacccaggcaaagguuuauaaauguuuucuuucauuuaaaguuaauguuaauauuauacaaagauguuaucagucaucagauuacaagugaauauuuuaauaucagcuggcaaaggcuggaauauauccuauuaccgaguuggaacacucaauauacucucagaacauugcuucucagccucugaaaccaugucuaggauuccaaugugaaguuuuagucugaauuagugacucaagccuauagucccagauacuccgguggcuaagucagaugaaauguaaguucaaggcuagccugggcaacauauugaaauauuguccccaaacuaaacaaacuaacuaacuaacuuacaaaaagaauuugugcaggucuuguucaggcaaacacaacuguagugaguucauuaguguaagaaccaaaagagaccauaacugcuuaaagugccgagaauagcuuauuuuaacaugcuauugagucuuaauagugugugugugugugugugugugugugugugugugugugcauucuagagcuauagcuucagacuuuuggguaacuuuuucaaguuuuuuuuuuuauaaggucaugugguuucucgaaccccaacaguauguuaauuuacccaguuuucgucaccuucucguguguggauucaugggagggacuagacaagcaacagacauacaacuugggaagucauccgaagagcagcuucaaaggugagggcggauucacugacucucugcgaggguuuuaacucaugccuccgggucuaacggagggaaaucaugcuuguugauccaucacagaaguacuugccaugaacuaaccugaggcuccaauuucaaacaggauaugaugacggagacgaaucauuuguuaucuuagaaaguccuggggaauggucgucucucaccuggggucuacgucagcuauucugaauuuauucuccacuucucccuugccucuuguguucuguauuuucacugaaugcauguuucuuggcuacccuccuuuugucuaagcucacucaucuuaagaaacaccuuuaucuauuacauuauagcuauuauacauagggaaggauuuaggcagaauuaucacaaagguggggggcucauugauggugccuauacauggucaucuaacuaaucaacaugcccauucacuuggacccuugccccauagcaucucccuuugcuagaaagggcagggcuaaguuauuuauuauaguaauccauucucauucauauucucucugugugugucccuauacuuccuccccucccccucuuucucauacaggccucugugggccugaaacaucacugugccagaccagguuggcccugaacucacagagagcagcucgcuucugccucccaaaugccgugauuaaaagugugcacugugauauucagcucacaguaauuucauagagagauguuuuuccagccaugcaauuagccugaggucagccuguaucucugcugacuguugcuaacucacaggcugcuguauguuuagcuuuaggguuccuuuggcaugcuaucaaguaccacggggcuugcaaugaguuaaacacgcccuuuugggagcuggacacugcugagggggaggggaaauguuuuguaaccuaaaggaaagccuuuauauuuuaaguucuuuuaaaaagaggaagaucagauuucagcaaaagacaagcaaccuugccucccugccuuaggggaucacucuguucaggagauaaggaugaagucauaccacuaggaaacacucccgaggaauucccuuccuuugcaggacagcuugcuagaggauggcuauuucacugcugugugccuguguaccugugacagacaggcacacagagacagacagccugagggacaaaaaagaaugaaugagaauuaccaaccaucaagaaccuuaucuccagccagacacacaccaugggcuagggaugcagcucagcaguagggaggugaccuaaagcacaaagacucagggaggauuccuagcaaagccuuucccgcaguacuaaguaacugaaagaucucagccacugauuuuugcuauauaaauccuaaaacaggaaaaucuaaguuuucauccauaacccagaauucagcggcggggguuaaugcaaaggcuuacaacuguguucaguccuaaaugggacuccuaugucaacuccaccaagccucagggaaaaucacagaaaaggaggcagaaagaacgaaaaccuaagggcuggagcauggggccguggaaugaggucgucuggacgugccgggacuccugcucauggccccacagcaggcauaauuacuugcauguaaucauacacauucgaaccuacucgaguuugggccaucagcuuuccaccauggagaggggagggagggguguagcucucugaggagcccuuggcacaucacacacaucacacacacacacacacacacacacacacacacacacguccauauacaugcuuacaaaagucggaagucgggggauguguugggaaggagaaggggcucaaugggugugggaggggauaagggaggguaaugaggugguggguacaacaauccaaauaugccauguaugucuauacacugucaaaggacaagaaaaaaaaagccuggcauaaauacaucugucuacuucaaauaaaaccaguccccaccccccccccaaaacaaagaaccuauguguaaguuuugacccuagcugucaacuauuuuuuuuuauuucuaucacuuuaauauauaauucuuauguccccagucacguacaguaaagcauuuggggaugcagaauuaagacaggcauuccccaucaucgaacacaaccaaccacacacaauacccucagcacuauugaaacauaagcucacucuaagucuuccagaugaccaacaaguucauaaguuuaaugagagacuuuucaguccuucugccagacuuuugccguagagagaacgagucgaaauagauggaaacugucugguuucauaaaaacuguaucugcugugaucucagaaagcagaccacugccaagucuguguggauuucuuuggggggcuaggacuugugugcacgcaugacuggccuucacuuugagcaaugcagaaguguagguuguuuguguccgagucugcacgucaaagcaggaaugugacggaugaauuuaaauaaugccuaaaauuacucaaggcuugagacgguucuaaaaaaaaaaaaaaaaaaaaaaaaaacacuaucugccccaggaaugucccuuggacacugaggagaccugugacagagugacauccaccuguuggaaauggggaauccagauagugccaaggauguggagagaggagaagccuguaacggagagacagcauuucaaaacaggacugguucgugacuucgugauuaaguggaagucuguuuuccauuuaguuuaaacucuggguugccuaugaagacauccuauaaaauuuugacauauaaaaauaaccagaagcaggaggugcuuuuauuuggugugaggccauguacuuauuucucaggguuaacugacagcagucaauuacuccagggauuguauuauucucgcccgauuauaaaacgcaaagagauauauggaaagaucuggugaacccccagccuggggaagcaaaaucaucucccucaguacagugggccuccugcgacugcaugggucaacagcaucuuauauguaaauugcugguauucaccguggguaagaggagucccagagagcauuuucagacucaaaguguguuacagaggugauggcucagcacuaaggagugccugcuggucaucuggguuugguggugcuugccuuuuaaccucagcacuccaggggcagagguagauggauuucugugaggugagaccagacugaucuaccuugugaauuccaggauagccagagcuucaaagaaaacuaacauucuauuuguagcacccauauuggucauucuuaguaaccuguaacuccagcuccauagggucugauaaccuguucacaucuucucauguaccugcacauacaugcacauacuuauacacauuuacacauauaugaguaaaaaaauuaaaagagguauacggauuuaaauguuauucacuguaauuuacuuuguaugauccuaaggcugguccuaagagaugguuagauaucaugaugauaacauauacugaggaauaugaaggaggggagggagguguauaagagaugguuagcuaucaugaugauaacauauacugaggaauaugaaggaggggagggagguguauaugaagguuuggagggaggaaagggaagggauuaauguuguagucaaauuauaaucuucaaaacaaaaaaaauaaccccacaaguuuuaucacaugauaguguuugcuccacacuuuaaaauuguuucuccuaguauucuaguauguucuacauacugugucaguggugaaaagcuacaaagagaaauaagucaccauacgauaaaguugggguucagguaucaaaagaacacccaggaaaucuuaaugauccauuuaaugucacacaggagccauuaagccugaucaccaacuuaguaccauagccauuuucuaucuuacccaugaugcucuccacagguagaggauccaaagaucuguuccuuauacuucuuagcagcugaugguugcugaggggcagagucacucagcuuuuagugugaguccacuggcaggucgcccgcauccuagcggauggucccacauuuacauacauaugggcaucaccaacuggacuagggguuauuaauaacagaaaaagguaagacauggagcugugaugaagauaagaugugggcacuggggcaagcuggagggauguauggaaugauggguggauaccauggaacuguacuauagacagguauggcauuuucaaagaauaaacacaaaaguauugcuuuuaaaagacaaauccauuauggguuauaacaccuuuaaaaaagaaaaggacaccaagagccaagggaggcgcauguuuucaaugugggguccaauuugggauggaggauaggaucaagauaugucauacauguguuagcaacagucaaagaauaaauaaauauuugaaaagacuugaaucaucaaauuugggcaauauaguuugcauuuuuaaccccuagugcaacuuuaguaucuaagauagaccuagguauugaaugggugucagcagguauuuaauguuuuuaaaauuaaaaucugauuucuaaaaauauaauuaaaaaauaugaaauguuagacaucaagagggaccagucucuuugaugauagucaugggaaccaaugcaucccaaggugguugaagaugggacauugcuaggaccuugccagguuuugacauagugcacacgagaggaugagaaagagaggcaucauucuuacagggcugcccuggagugucuggcaaauacagcuuucugcugaauuucacauuguaaccagaacggagacguaugcaaggccagaaaugcuguccguagacuuguuucugaggauggaacagcauuuuucuuuuugcugcguucccacauucugauuucagcaucccacaggauuguaaaacauauucaacauuuuuauauuggagugaacauauuuuuggcucccaacgucuccauuuugguucaacucaucgucuucguauggaaaggaaagugaacuuuauuuaacucccuuuaaagaauaaugccauggaucacuuggacauuaagauaaagucuacuuuaggaaaauauaauuuauuacuuauuauaauuucucugucacugucucucucugacauugccuuucucugucucugucugucucccucccucccuccccucucuucucucuuucccuuugucucucugucugugucucucuguuucugucucuguuccucucucucucuuucucugcccuucauguuuguaugggcaccgugaugcugaagccgugauacacacguggaggucagaggacaaccacuggaguugguccuugcuguugaaccuuguuugagacagucucuaguuugcccuugcaucugccaaggugguuggucuacaaacuuccagggauccucucgccucucccuacaaucuggcuguagaagccucuggguuacagacagucaucaucacacucagccucaugaagggucaggggaacucuaauuagguccuuacaacaaacaguuuaccuacugagccaucuccugagccugacuuaauacaauuuuaaguuuuuuaaaaaaaauaacccuaggucaucaguuuuggagagaauuaagugugauuaaaacuaaccagaaaauugaggcuggagagauuggcucagggguuaagagcccugacuacucauuuagaggucccaaguucaauucccaguacccacgugaugacuuacaaucauuuauaaugggcucugaugcccucuucuggcacacaggcauguaugcagacagaacauucagauauauaaaagacacaaaucaauaaaucuuuuaaaaaaccaaacagauaaaaaacuagccagaaaucugaugauacucuaugaaaacaaaaagacucaaaucacccagauucuuuaaaaaguucaaacaaauauaauaucagguuaucugauuuauuuuuaagcuucauguauguucauacauuuaaaauuaauccauacuugcucuaaaaaucagaguaugucuauuuggccacagaaguuacuauggggguagguugucugucagauuuuauuuccagccugcuacauuacacuucauugaauguagcugcagaacaggaucauaacguaaggcucuauaaugcuuaaugaucacaaauauuacuguaguuuacaguuuucuugauguguacuaaagguuauuuugcagggcaggugagcuagcucagaggauaaaggugcuugccaccaaaccuaaugaccuggguucaaucuccaguggaaggagagaccugacaccugagguccucugacauccauacaugcacugcaguaugcaugcucccaaacaacacacacacacacacacacacacacacacacacacacacacacacacuuaaaaauacuuuuaagaaugauacacacuccacugaacauacagcacauauuuauaugacuuuauucaaauacauucuauucaacauucuccugauaggcggcuguuacuguuuaaggagcccuuuguauuuuaggaacauacagauggaugaaucugaccaguuuuagggaacuccauccucauuuccuugaaaauuauuuuugaaagacuggaggaguggcucagccuuuaagaguacuggcuacucuugcagaggaccuggguuugauucucagcacccacauguggcucacaacuaucuguaacuccuguuucaggagaucaguugccuucuucuggccuugacaggcauacacaugguguacagcuauacauguagauaaaaacauuuguagucauaaaaauauaucucaaaaauccuuuuuaguuacugguuagaaucuuguuagccucugaagaagccaaauggugugaaguuacuuugucaggguuaaaugaugcagcugaaugagcuugauauuaugcaaggcagcauaaagaggcugggcugaggcugacauaguguuuagcaacaguguaucaaacgucugcuuaacuugaucaguacccacugugguacagucacgcuucacagucaaaaggaaggcucagucacuccacucucacuagcugccauuucuccucuuauuucucuguuguggcuuuuccgcugaguggaucuguuuaggggcagcugagcuucaauuacaaacaggacugugaaaaacugggaccguuuuguguuuaugaacuaaauugcagagagaaaugaaguuuaaaaaaauguuugcuggucuugaagacguaaaaagaccauuucucacugggagugacccauccuaacuccugguugcucauggaagaugcccugagagccauuuaaacugguuuccuccuuuuguuuucagucacauuuggccuaugaaaauuugcuuagcaauaaaucaauggccuucuaaagcaaccaaaggagccauagguaaagguaccauaccuuggcuugugauuaggccaguuuccaacaguuucuaaacugggccuaguuuugaaacguuguccuacauauuuaugugaagugguguccucagcuaugacgauuauaaaaucaaaacaucgaucaacccuggacaauguugaagaucuucuagacuuugcauuaccaacuauucuaccaaaauauaaucuuuauaucaaguaauggcuacuggaggagaaagccacaaauuuacuaagccagccuaaucccuaauggaaauccauaaacauucaucuuuaugcccacagauaaacauagucuucaucccucaucaagaaaacuuuucuaugcaaccaacagaggccauuauagaaagucagaaccaaucgaaauacaagauugugaagcccagucacaguggauacaucuguaaaagacugcuuuucauauggcuuggggaacguucuggaagagaaagugaaaagacuguaagggucaggagcucagggaguuuacuaugagcuugugucuccuaggcauggcagaagccacacgcauuaguucacaccagcacgauugcucaaaugugaacugaccaaggaugacgccaauggauaauaccaauguagauagggaaaagcccaugaggucuuaacccaacgcaaagaacuacaggaaacugaaaaguggggaugggagagguggucuuccccacggaagaccacaccaagugguuauccagugccaaacagcccugaaaacguauauucaaguagcaugacucagacuaaacagguuacauucaggaauauaaaggcagguaauagcaauuaguggaaaaagaggccaggaaucugaaagaggguggggugugggggguuauaugggagaguuuggagggaggaaagggaauggaagaauauugaaaucaaauuauaaucucaaaaauaaauaauacagugacauaacucauaaucuaugcauggcacaaaucuuauucuaauggguuauuuaaaaaaagagagagcccuaaauuuggaaggugggaaauaggguucaucuggaaggacuuaggaggaagagugcagggggcgggggggggggggaaugugaucaaaugcauuguaugaaagucucaaagaauucauaauuguuuuugaaagaauaaaagagauaaggauauccauuuuaucaguaugcaucuuaguuugcuuccuguugcucugauaaacaccaugaucaaaacaacauggggaggggaguugguuuauuuucuuuugcaguuuauagucuagcaccaaaacaaacaaucaaucaaucaaacaaacaaacaaacaaaugcccagacaggaguuccaggcagagacugaagcagaaaucauaaaggaacauugguuccgggcuuguucccuugcucagcuacccuuguuauaaaauccaggguagggcaagaccaccucccuaggaaagguaccacccacuguaggcuaugccuuaaucaagaaaguggcccacagaugcaccuaguggagacaauucaucaacagagguaugccaacucacauugauaaaaccuaccugacagcuugcggauuuauuuccccuuuaauaaaugauaaaauuauuuacguugcaaagguuauuuugaauaauaaauuaugauuugucauugucagcaugcaacaggcuugccuauuuuauauacccauguguugaggguugcuugaaauuuuccucaggugaaacaggaucaaaaguacaaaaaguuuaaggagcccugguguaggagaugguuggaggcuaacucaugaccaaguucuauggccaaccuuagcaaauugaaauauccacuaaugccugaaguuucuaaaaacagauuuuuaaauucaccuuuuuauuaagaagaagucacauugucccguuaugcuuuauugucaugugaucugggagacggggcuggccuuuggccaccaguuugcuuaccauggcaugaggcuuaacguuagguucuuaaaaugugugugccauauaugcaaagggaaaaagagaugaugugggcagcaaaguaagucauucauacaagagccaccauagcaagaaugacuugcccauucuacaaauguggacaucaaaaggccgagaaaacaagaaguuucccucaguuacauuagcaaguuaagccugcauuucuaaccuucaaaucucaaguuguagaugguuagcuugggucaauggucuuuauaguucaucaguaaguguuuaacaugucacacaguagauuccauaugguguggugguuaguacugacucaacuuacaccaucugggaagguagucucaaugggacugucuaaagguuuccccaugagcauacuucugauagacucuuuuuaauugaguuucuuggaguuagaagauccaacacacuaugggaaguaccauucuguaaguacgggucuuggacuauuuaaagaguggagaaaaugaguuggguguuuuguucuuaauuuuuuuucucuauucucucugucugcuuuugcaucauggcguuguaaaagccaaauaaacccuucucucucaagaguucauguguuuuaucacagcgacagaaaugugacuaggacauguggagcaugcaccuuuauucuguaccaucaugguucaaaaggucccccacagacucccacacucuaagaaaugcugugauucuaaauuccaaacagauugcauggucuugaaacugaaacugacaugcauguggcaagcaguagucucugguugccugcagagacugagagaguauuugggaaagauacucuaucccaaaaugaacauggagagauuuugagugugggauucaugcacagauuuuaaauaucuuaagaucuguaagaaaacaugccaaguuggaguuaucagagaaagaacggcuaaggggccuucucuaucuucaccaaggaaaucuuucuucuccugucugggcagguucagagacaaagcacaggacaaaauuccaggcuccuguggcaacauagagucaagguccagguaggcacacacuuuuugugccagcucaucagugaugucaauuguaguucaauagugucucugugagacauagucuuaauaaagcaacgauucggcuauucccaaggucccccucccccuucagcaaaaaccgggaccuguacccuauggugagacauaaucuugauaaggcaaugauuuggcuauccccaagaggcagccugcaccccgugguuuaucagcuuauauuaaaguaucacaucuagaguuuucauaaucugauacacacuccuuccaaugcugcuguggguauuuuaaugcacaccccacucacugacuauccacugcugcaucaauacugaagaugcaucuuaaagaauagggggcuaaaauggaagugccccuccaucccuagcaccacuacaagguaccgucaagguugcuauaauaguaaaagcauccaccaaagacucaaauaagaggccaaugcucauucucaauauugucuucucccucaaaguccauaucccggguaucucuagaaccuuccuuccuacuuucuaucuacauuuauacuacaagcaaguccaaucucuucauguucacacccccagugucaguuuuuagcacuucuuaucuggaacuaaagaugaauccguuucuguugucucucaguucacuuugugucccucaaaucauguuuccauucaacagcugaagugaguuuuuaauacacccaccucaguaagaucuggacaccgacuuagcaugaauuccgugcuccucaccgugggugagaaugucaccugugcucagcacccacccccacccccaugccucaagacaacuucucagucuggggcauuuacuucauccuuaacgaguuucugucuugaaaucccugcacuucaccuggcugguccuucaguuaucauauaagauggcucuucucuaccaacccguaaauccagagguggucucuguuuucuuccuuuagauuuauuuuccuccacggagcuugccaaaauuuguguucauugauauauuaguacaaugcugcucuagacuuuccaguaugcuaaguuuuauaauuccagggaggguugcgagcuuguuccuuuccuuuccuuuccuuuccuuuccuuuccuuuccuuuccuuuccuuuccuuuccucuccuuucuccuuucuccuuucuccuuucuccuuucuccuuucuccuuucuccuuucuccuuucuccuuucuccuuucuccuuucuccuuucuccuuucuccuuucuccuuucuccuuucuccuuucuccuuucuccuuucuucuccuuucuccuuucuucuccuuucuccuuucuucuccuuucuucuccuuucuccuuucuccuuucuucuccuuucuccuuucuccuuuccuuucuucuuuccuuuccuuuucucuccuuuccuuuucuuuucucuucuuuuuucuuuuuccuuuuccuuuucccuguuuuuccuuuccuuucuucuucucuccucuccucuccucuccucuucuuuccccuuccuuuucuuuuuucccauucuuuucuuuucucuuuuacuauuuuauccccagcuauauaccugaauucauuuacaguuaagugaggaaccaaguagaugcucagaguguaaaauguagaagaccucaauaacagcuucaaacagugcuauuuucacuuuucagucuucugggguucugguaaauccauucaggaaccaucaaaaugucacauaaauucacccagaauagcuuaucacacacugcaucccaacucccacacagggcaaaaauaaucucuucaccuuuuucugccacuuucaccaaggacccaccagaggcuacacccagucaccacccacuuuacuccaaagagaucuaguccagcugauccaggaagcaggaaaaacgaacaggaagcuucaguuuauacagaggaagaaucugccccuggaaagagcuuuguugaucacaaacuuggccaaaauaucccaagaggauggagacacaguguucugaaggagcaagcgcagagacgcuuccugagcacgccaaggacacagucagcgcaaauagcuuaacuacagcaccaggcagcuagaaugaaauagaguccuaggcagaggucaucagccaggcuccuggcacccgucuuaauacucagcguucauagugaccuucuaguugccacugauuugugucuguuggguauauuucaaugauccugcugauucacgugcagacaaagggcuguggcuaagggacauagguaaaguccaugccuggcauauacaaggccaaugcuuagcgccaacaaaauguuuuaaaacucauuugaguagcaacugugccugcacagcccagcucccuguucccagagcuucugcaccuuucuaggucaacuggaacagguuuuccuuaagaaagguuuaucaugugaauggcuugucuuuuuucagcaucuuggaugggagguagcgucauggucacgugcauauguaucuagagaaauguuggcugugcucaaugcuucuauuguccauucauauguuuuucuuucuuguuuuuaaucucgaagugaggggaagcuacaaccuacaaaauuaugacugaaugccugcugacacccaggucagcauuuucucuacuaaaaagccuccuccugggccagcugacaauguuagaaauagcuacaaugggcucuccgaauggcgggcacaacacagaaucaucuaaugaguauuacuuuugcauuccuggguacuccuaggcaggugaagcggaagaagacucccuuuuaaauaugaaaaccuucuaaguagagaugcuaacuacccuuuccucuguguacucugaaaggcugccuaucaggaaaugagcugagugggagucuucugagugugcucaaguugucgccaugacacaggaggcacuagccucagaaucaaacuuacuucaaagaccagcgucucauucguggguccuggugcauacagucguucagggcgguuaaaggaacgcugguauucaaacguggucccugcgaaggugaaguccccuggccagucgaugcuccagcccccugugagguaauacuuuugacugaggcuucgaacagcaagauagcuggaagaaagcugcaacuccugaaucucaaugcuucgggccccagcggggauggugaccacaggguaauacucuaaaagcacacagaggaauauuccacguuuaacacuguagauuggggaaugguaaguggacaugcagugaccauuuugauggggccuuugagacuagucaauucuauuuaaucuagugaaaagacaaauaauuucuuuuucugcuuuuugagauuuauucucucucucucucucucucucucucucucucucucucucucccucccucccucccucucccuccccccccucucuuucccccucccucccucucucucccaguaugugugcuuuuguaugcacacaugagugcauguguuucuguguguaccuaugugucacagcaugcgugaagaggccggaggacaacuuuggagagucaauucuuccuccaccuuggguucugggguucaaacucauguugucaggcuugguggcaauugccauucucugaugagccauuuuguggcccuacucagguacaaugcauagaugaaacugcucacccauagguccuaagaaccuuacccugugacaagagcuaccacuagugucaggugagcuaggguccccauucagaggcagaaaugggacacugccaggagcaucaaggggauggaaguggcucuuaccauuugcuuugugcugacugagguacaggcccuuauaaaacuugcaaguugaguuaucgccuuugcaaacaccacaugcaucagaaaccgccuuagagccaagcucauggucacaucccaccagcuauaaugaagaaaaguggggaagaaucgaagauaagcaaaccuagucgugaagacuaacagguggggguugggcagcucugcuaaggugaaagccagagccuuaagucacacuggggcucaaagacuuccucaugcauauaauguauuuuguucauauauagccccucccccuuccauucuccuggaagucucccagacaucuccucccaccuucaugucuucuuucucugguauauuauuguuguuugaaccugcugguucuaaugagugcugaucuuaugcacacagaaguguggagucaaccacugggcuaccgguggucuacugguggucaccuuccccccuaagcaaagugacucuucuucuguaagcaaaugcauaguugaucaaauugcaggauggaucugaggcuuagacucuagcucuuggaaacgagacuaaagagucaugggauauuaccagauuuccaggccaacugucugaaugaagcauaaaaaugcugagcugaauacauucagacucucucugugcauauacacacauguauacauacauacacacaagcauaaacaggcauguacccacacaugucuauacauaugcacaaacacauauaugcacccaugagaaacuacccauaugcauaaaaauaagcagaggcaugugcuauauacacacagacacacaugaagacacacacacacacacacacacauccuggaaaaggaugaaaugcucuuaaugaaguuuagaugcaauggaaagugaguccccaaagacaugaacucuaaagagaggacagcucuguucccacugcacuucugagguucuacuacuuggcgaauaugcuuaguacacaggcauugagacaucaccgucauuucugucuuuaguuuuuagagcaacacaaaaguggcuguaacuuacacacauucucuaugccuagaaguggaugaaaacagaagaugaaggggucuugugaaaguuagagaggggcucgaaggugcacagcucagcuggaugccugacccaucuucccuaugugcauuguagggacucucucaaucauccucauggcacucgaagagacaucagccugacugcacacccuggggcagaaauguccucuuacuucacaaaucccaucgaugcagacgucauuucuguguggggaacaaggcgucccaucuuucaccuugccagacauggcaaagaaaaacucaaaguucuccgccuugcaguagaguuuacaucgaucuuccucuagaagcagagagaucaaaggacaggaucaaaacuagcuugggugcaaaacaguguggccaccagagagagcaauuaaaucgacuuggauagcaauugugagcaaagcagaucgcauucuauauaauuuuguuuguaagaauguccguggaugugcacagaagaccgcaugucuuucaaaagacaaaucccauuugagagcccacacaaagccaauuaaguauugauaucaaagaauugugggcaauuuuguuuuguuugagagagaauuucacuaugcagccauggcuaaccuggaagugccuauguagaucaggcuggccccaaacucgcaggccucaaccugucucuaccucucaagcccugagauuaaaagacugucaucaugccuggcuuggcaccuaagaauuugguauucauaaucuauaggaaucaaaaccacauacaggguugcuggguugugcaacagcuucccuggacuguaaauauuccaaacuuuguagucccuacaguugaugaguagcagcagagagguaaagggauaucuuugugucuuaauuaaauuuucauuuuuacaaauaguucagguuauagacuuuuaaaaaagauuuauuuauuuauauauaugaguacacuauuguucucuucaaacacaucagaagagggcauaggaccccacuacagaugguugugagccaccacaugguugcugggaauugaacucaggaucuuuggaagagcagccagugcucuuaaccgcugagccaucucuccagcccccucagguuauagucuaaugauuugguuugggacuugauccccucagaaacauacagucuguaaaaagguuuuauagaucgacauacuucaaaaacaaaaccauguggucuacaauguuuauaaaaaauaucaagucgaaaugucacaaacagaaaaaacagagaagcuaauucuaaaggcaaaaucaguacuuuuaguugaccauugagccccugggagauuucuaguaucauagggaaaagaaaaaaguauaguuauagaacucuuguuaucuggaaggagaaagcaagccaauacgugcgauagagacagccauccuuggccagcaacuccagaugacguuucucacaugggaccuucuguaggcgacacugagugauaucccuaacaacaguuucacacagauguauaaacaguucacaaacaguccuguuuuacaaaacccuucaauagaaggcagacuuaaaacuuacaugugagacaaaauauauuacugugguuaaaaaaauguguagauguguggguggauaaaaugguuuucuuucaacuacagugucuuuauuuuucaaauaacaacuuuauuuaauaaauucuaaguucuauaaacgagauuaaggggggagguggaugauguguguguguguguauguuuuucuucuguauuacucucaggaauuaaaaaguucuaauaaaagcuuauuauuugcuuagauuuuggucuuuuauuuguucauuuuuuuucuaauauagaucuccaggcacaaacuugccucuuaaaaauaauaaaaaagaguauuuuuuuaaaguuuacugcuuauggaaagcucuucauuuaugucagagccuuccccuguucuuuugguuuggcuuuguuuuugagacacccccacuacguagccccaagcuggcuucugacuucugcuuuaugcuacuuacuuuguagcaugaaauucacacacucucgggucaccuggaaggaggaaaccucaacuuuagaguugcucagaucauauuggcccauagucaugucuucuagagagugucuugauugaugauugauaugggagggccuagcccacugugggcagcaccauuccccaggcaaguagaucuaggcauuauaagaaagcuagcugagcaugaacucgagagagucaguagaaaguguuccucuguggcuucuccuugaguuccugcccugaguucucuggaggauggaucgggaucuggaaguauaagaaguggauccuucucucagcuggguuucuuuuguuaggguguuuaccccagcaaugaaaagcaauuguucaucaucccaagggcugaaauuacuagugugcgccauuccaucugcucuucuguucauaaaugguaggaaugugccagauuuucaaauaguggucagucuccucugauucuaagugucauacgcagaagaaggcaaaaccaagaggcucgacugugcugucucacccuguggagacauuaggccccgaggcagcaaauucucauaaaacaagugacucaaacugcauggucccuuguuagcaaagucuguaaugcaguagugaagcuucagugaagcccagagcauuuuucccagcuacagacuuuuuagcuucgcuuuacauuucagcacagagcucagagaguaacaagacugcauuagugcugcauaugaugaaacgagucacgugugaaggucaaagaacacauaaaaagucaaaggacagacagaccgcaaagagaaggacacaggguuuuaaagaaagaccuauauaugagagacaugggguuguaggagugugaguguguguguguguguguguguguguguguguguguguguguguguaagagaaaauguaguuuuaggugcuagaauagaguaauuugaccuaucccaucuguguagcaucuuucucugaucauuauucaauccuuuauggaaugccuauagugauagagaacucaucacuuacacagggaucauguguccccuuuggacagcuaauauucauucauucauuccaaauguuauagcuauuaaauccggguaugguaacacacaucugucaucccaggauggagguuaaaacaggaagacugggaauuccagguuagccuuggcuacagaaugauacccuguaccauaaaacaaggcaaaacaaaucccuggccuuuaaguauagacuacguagucuucuuggaugcuguggaaaaaaaacauguugaagaugugccaagguuuccuccccuagacccuaaguucuuguaaaaauaauauauaaaugaauacaugaagaaacaaaugacuaaaguaaaccggagacuggaaaugguauuguucaaagcugugccaucuguucuuaaugccaggccaggcgggucuguucaccauggcucuuuauguacaguagcucuccugaugccaaccaacaacacagguuuggauuuuuuuagaacagggacagccaucaauugucaaaauugucacaccuguccccuucuacauguauacaaccaagaguccugaaaauccuuccucaagaaaguaaagaugagaucugauaaauacggacacuacaaagaugccaagaaacacauggacuagugauggcuuacucagcauggguaauagaaaggauaucagcguugccaugguaacagaaacaaauguuuuguuaauuuuaagaagucaaaugcaucuaggcaugguggcucacacauauaauccuggcacucaagaggcugaggccagaggauugccaagaguucaaggucaaucugggcuacauaacucagccugggauauauauuaaauucuagguuaguuucaucuaaagaaugauacaucaucucaaaacaccucucucguguguuucaaagucaaaagcaagcuauaacuuucaguuauaauaaauaugaaaaguucugaaugacuuuuuauucauucugugcauacacagacauauccuuuuuacaaaaaaaaucuuccuguuauuuccauaaucuaacaugucuuuuccuaaauauucugucugcagggcauauguauaugguuucaugaguuuucagucuggacaacucauaccaauuucaauuaacauccccgggagacaaaagccaccaagcugucaacgguacauuuaaggccggggggggggggggggggaagacugugcaaaaauaaagaacaccuaugaaaauugauaaaacaccaaaccaggacaagccucagaaacagaaaauaagcauggaaaauguguagugaauuuacauacuaucuacagugagacaguagagugucacaaugaccaaaugaguuaccuucaacuuuuguguaggguuuccaacgguacaaccauccacggaagggcuuguuguuauacucugcacacuguugggcacggaaauccaagcuauucucaggacaaggguuaauguugcacagcuuguagaugcggcuagauccuggacaguacuugccaccauacugaggccuaaaaccagaauucaagaauuucagcacuaagcacuccacucucagccacaugcaauaacacaggaagggacaauugaggagagcaucauugugcuaugggcacuuauaucuagcuuauuacacaauuggaaacauaugccccaugucugguuacuuccugcuacuaugcagacauaacuaaucaaucacagaguuccuuuuuuuuuguuuucacagggacuuaauauggccucaauaauugccauaucguuuuaaucauacuggaaggcaacugcugcuguauuuaauuguaacuggcacauaaaaccaaacucauuuccuaucucugacccaauuuuauguucuagaacuugaacaacugaugacaaaacuaaucuugauacuucaugugucagagacucuguggucacaguuagauagucucugcaacagaucuuuuugguaccacauacucacacuaucugcacuggcaucuaaaacuucaaguacagauccgcccuguaucuccaggcucccuacccugacuuuccaucauauccuaaacaucuuccugcgguucucaugcacuugcugccaugaaaaucauggcgcgaggaagaaggaagagaagaucuucuuugccacauucuccagccugaagcuagcacacugguuaucuuccuacaccgggcuguuuaauuccaaucgauucuccacucugagugggagacacagccugguggucaccagcauaaucaccuuuuaacuuugguagccugcugcuuuccugccaagcacaaugagaaggggaacauggcucccagggcugagagccugauaaggaugugaauaaaugcaaucucaacacuaaccucuucacauccuagcaagcaaauccagauuggcaaaggccaagaggaaaacauggagaaaacaggcaacugcaaauuaguaccguucccaccaaacgcuaaccucucagcuagucuacucugacacaaguacuuuccuuugcucucccaauccauagcuuucuccagagcuaauacucaaccauggacugcuucauagaaaaauccacuaccagcaggugacaugaaaggagacucaagguuaauacauugaugugauuaaaauucuuugucuccauggggagaggcuugcuauagaacucugcuagauucuaugccacagcguccucuagcauccucuugagguccuaugcaugaacuucauaggcacagaaagagucuccuggccagaaugacacuuuuaugccuuuuucaaaaacacucuggagcaaauggcuuacacguguaguccccacggcgcuccagcagauccccccaagacuucucaaaugaucauuuguuaggcagcuagaaaaccuuaaguuguauuaucacugccccaauauucuuuacaaggaguauuaagacaaauucucagcuuaaggcuuucucucugagguuuuaaaauguuggcugcacuuggacuacccauauucguaagguuaauggcuagccaguguguaacuuuuccaaucugcaaaguuugaaaaggggccucagacucacagcucucuacucuucagauagaugaagugaagggugggcagguagacuacacucagcaugccagugaagguuucacaguucagugggacagugaggcugaaccccagaccuuuggauucugucccagacucucuuccuugucaccuaggauugcauuuaucugagcaagacaggugcaugggaacugacacaaaccacacgggaacggggagaaagauccgguaagcccagugguuagagacccagccuucagcacugagacagcuauguauuuaauuucaugcaguuucaaaaacugacucaauguuuuucagacuuuauagaugaguuaaacuauaaauauuuuaaauaggucauucucucaaauuacaagccacacuaugcuccccaugaucggaaugcccagauuucguuuuucauuaugggauagagucagaguagucaaagcgaugacugccaagaaguucggauuuccugucaaauguuccaauccaagcacguucuccugcagccuuuuauucugcuugagacccggucucaaaagguagcacgagcuggauuuguacccagaaucuucccaccgauggcuucggaaugauggguggguuugagggccuguuuggccacaccgggaugucuguggcauucgcgugaggguguggauaagugaacagaaaucuuuugcauagcauccugcagagugguaagcucucugugauuagaaacaaaaauagaggcagaaaacgaagucuucgcacaugauguuguauaauaaagcagaacuauauuuuuguuuuugcaucagugaaugugaccagagaugcuuauaguguuuguugguuacaagacuauuagaaucacugggagaauguuguuaguguacauauggguacacaugaauauaacaggauucccucugcauuuucucuuacaaucucuuauauucauauuuucucucucuccucucuuccuccauuccuccauucuccauuucucucucucucucucucucucucucucucucucucucucucucucuuucccucuccuucccccucccccucccucccucccugccucucccccccacucucugacaaggccucauguaucucaaacuugcuacacagccaaggaugaauuucaacugcagaucuuccugacucuaccuccccagugaugccauuucaggugugccaccaagccuggcuucuguaguacuggguaggaaacuaagacagagagaguucucauacaugauguguuauaaugugaguuuuccaaaggaacuaguguaacuuuuaggagaccgugcugaugucgauaauugaaccuggaaauuacugucuagaaaaaugggacccagugucaguucaaugacuauucggaagccccagcuuccucucaaacucccugggcuagguggcacuagagugagcggucuacaagucuuugugcuuuaggaaaguucuagaauaucucaguauguugcuauuaauuuuuuugaaugacaucacuaggaauauuccuaggccccguuauagcaugaugguuugguagauaaagaagcaagagaaauguuaaaggguuaagccaaauguuggaccuuaauuugacuuugacauuguccgugugauacccaagcaggugcucuauugucucuguugaugacaaaaauaaaagaugauguaaggucggaacggaugcgcuugggagcagaggucuggagaaguauuuugaaaggcuacugagguguagcagaaugcuacagaaaacaggguguggacgaaauagaaauaccuguuuagacagaggaagcagccauaccuccagcuugacauuggcuguuguagggucagauggucuuuaaaccauuuuaaagcuaacagcauuggugagucuacaaaucagccuucucuacuucauaauuuuauuaaagaaaacacauccuuggaagaagcucaguagaugaacuaggaaccaccuacugcuucucuggggagaaaauggaacaguucaagcuaagaacuacagacagaaccaaaugggagaauuuagcuggaagagaaaaauaagccaggagcuucgaguuugaagagugagaaugaaagagcuuugcucuaauaaauacaguuaagagcugguauagaagaacucagccaaccaugcuuggaugggcugauagccauuugguuuauuuguggcuucucccugaggaagaggagaguguguuccaauuauccuugcucucauuuaacaugacaaaacuccacugaguggaaauaguuuagugauuaauucuuucauuuggaaucucuaaaaccgagauaggcuauuuccacaugcagcgaucuaucauauauaaggagaguucucaaucccauagauaugagaaaaguuuuaauuuaaaucccaggggcaucuuuccugcacuccacugacagagagcuauuacuuagguaauuucuuucuugcuuagaaaaauauuuagauuauaaaauguggccacguaugaaaaccagacccaggaaauaugcuacaaaacccagagugacagaguaaaucugcacugugauuucuaggaccguggcuguaguuaaaguaucagaaaguuuguuucuauaauugguguaaaucaugaauggguauccagccuuguuccugguguauucggauacugagucugaggaguucaggaagagacacauucuacuccuuugaggacagguggcaaugccugaagacauuucaguuuguuacaacuuggagaauagagagaaaacagucccaucagcacuaaaugccaagaugccauggaugcugaaaaucccacaauguacaaaaaaaagcccagggauggggagaugcugagcgcaaagacuaaaggaaaggccauccagagacugcuccaccuggggauccaucccacauacagacaccaaaccuggacacuauuguggaugucgggaggugcuugcugauggaagccuugauauggcugucuccugagaagcucugccagagccugacaaauacagaggcagaugcucucugucaaccauuggacugagccuggggguccccaguggagaaguuggagaagggacugaaagaguaaagggguuugcagccccguggagggagcaacagugucagcaggccuaacccuccccccgcccggagcuccuggggacuggaccaccaaccaaagaauaaacauggcccaugaugcuggccacauauguggcagagaauggccuuguuggacaucagugggaggagaagcccuugggccugaggguguuugaugccugaguguaggggaaugccaggacaggaggauaggagugggugggugggugggggauuugggaugggaugggaguuuccaaaggggagaccuggaaagggggaaacauuugaaguguaaauaaagaaaauauccaaucgccccccuccccaaaagaguaauuguaauuaaaaaaaaaaaaagaauacucugcuccaaugggaagggaagcccuugguccuggggagguuugaugccccagucaguguaagggguuguuggaguaguggugugggagaggguggguaggugggggagcacccucauacaggcaaaggggagggggagggggggagggggaugauggaaggguaaccaggaaacgggauaucauuugagauguaaaugaauggaaugauuaauaauaauaaaaagaaaagaaaaagaauacucugcucuugcugaggauggaggaguucuacugcuggcacucauaccuggcagcucacagccuccugacugcagcuucaggagacccuauucuggccucugcaggcaccuguacacauauguaucuacacaugcacauguguacaauccccccauacauacacuaggcguaauaaaauaaaucuuaagugauaaacucacagagaacuucauuuuguuuuacaucaauaaucccaggucucucaaaggcucuagguuuacugggaccacugcaugacuguagguagguuuauaaucagagcuauuugugaggcugagggaguuguacugcaaauuaaaggccagccugggguagguaaagaguucauggcaagccaggaccucagcuguaaauacaaagcuaaagaagaucugcaaagggagcuugcucagggcuaggauguguaaggcccagagaaucaauccucaggggagggagaggggagggggaagaugagggggaggggagggggaagacgagggggaggggagggggagggcuaggaugcuucacuauuguguguaaggccccagaaucaauccucagggaagggggagggggagggggaagacgagggggagggggaggggagagggagagggagggggaaggggaggcuggcuggcucuagaguugaauaagauaucccaggaagcacuaacauacagcaucuaauuaucuccaaccuguaccuuggaguuugggaaugagaaacugaaaagcuuuuuauagcacucggaucgcugaugaaggaccugaaguuugucucuuuugaaaaaguuuccuuuuuuuccucugacuucauuauguguuuugauucucaguucucccaacauuucugcugugcuuauggacugccagccgucuugcagagagagcacuuuauagaccucagcugggcugguguuugggucaucuagaucccauguucaucugcaaggacucuggggaaagggagagcaaguugcugguggcgucauagccgacagcguaggguuaggguguagggccagggugcugggcuccauagcuuauggucuaaacccccguagcugccaacccucaaacugguaguaaaauuaacucggcaaucuaccauacucuccaggacacuguuagugauaccucuaauaccacuuccuuuauggggugguaaucugugacucuguuauccuagggagguugaugugaggacuguggguaccauauggaugucagaaccuuuuguugucuauuaaauguuucuuguuuuucagaucaguuggugucugccugucuguuucuauagccaucugucugucacucucaauauaacaucucucucugucucucucuuucuuucucucugucucagucuuucugucucugucucucucaauauaagaucucacugugucugucuugcugucucugccugucuuccugucugucuucccucuuucaauuuaagaucucacuaugcuguguccccuaccucuguauaauauuuuacugugccgcccagauuagccuuacuccuccuggcucagccuccugagugcugagauuguaggugucugccgccaccccaggcauuggagggaguuuauagauacuaguccuaaucucuccaaaucuccugagauggaucuaaagucucauugugucuauaacacaagcuuagauuucugugacuuucccagagucacaaaguuagaaaagggcccaugaacauucuggagucuuuguaccuacacagccucauauauuucuaccaggagaaagagaaguccuccuuccacaugugaaucagucuuuccaaguuacuaaagcauccuuguguuuucucaggcucaggccccaugaugaacagaccacagagucuguaaaggugaccacaggccaauuuccccaugugacugcaugcucuaauuaguccucacagugucuuuuuguuuuacuuugaaagaaaauuaacguuugucgucaauauuuagaaauuucacgugcacggaugcaugcuuuuguuucugcucucuuuugaggagucagauggguccaccaacagggauuggagcugacuuacccuggaaggucaaaaaucguaacacguucugaguucaucaguuggagacacacauucuacccaccaagccgcuuggcuguacaacagcucagguauucgauucuaggacggcagagccuugguucaaacuaagaaaaaagcucagcgagcuaucagaaucuuuuuuuuuuuuuuuuuuuuuuuuuggagacaggguuucucugcguagcccuggcuauccuggaacucacuuuguagaccaggcuggccucgaacucagaaauccgccugccucugccucccaagugcugggauuaaaggcgugugucguauuuacacagagugauucugcugauguauuuugaagucuacacuccaugccucuucccaccccuguuuccagugcacagagccuucauauguaaacaguaaaaccuuggcugguugcuuugaaccggaaggaagaaaaaaaaaaucccacucaaaggucaaaucuuucuggagccuuacuugggguuacuacagugucucuccuggaacuugacuccuccgccgcaagugcgagaacauucugaccacuucgaccaggcagaccacuggccauggaugggccggggcccuaguucuccgagcuuuacacacuggccuugccgacaccacugcaaaagaacacgcaacacgguucaucagaggccaccugggaaaguuuggaagaggcaaauaacuacacgaucaaaaagggaaauggggucugggaaggcaggagagacaguaugugacccugugacgcagcccuucuuugcugugugguaugaauguucaggggcuccuggcuguuucuggcauuuucaaggcuuccuuuagagcagugguucucaaccugugggucacgacccccacggugaucacaauucugacauccugcguaucucauucugauucacuggaguuaugaaguagcaaugaaauaauguuaugguuggggucaccacgacaugaggaacuguauuaaaggggcgcagcauuagaaaggcugagaaccacuguucuagagaaaggcggcauuucccauccucaugcugagaggcacgugccuuauugaacugucuaugcagaggaaacguacagauaagagucuauacaguggcacaaguauucagaccaaauuacaaggaucccuuuguugccuggagacagugcuacuuauggaacaauuauaaggcuggcaagacuugaucacucugauuauuccacugucaaagcagaugcaagauacagcuaaugcgugcuuugcccuauucaacugacccauacucaucucacaugaaauuagcaacuuucuguacgaacaaauugcagccacagaaggugcccauuucagacccucugaggacgguugagcuucaacaucuucugucccgaggcuuucauuugauugugagucacacaggcgggauaaggguucuuuucucuuagccucccaugcuauuuguuccuuuguaggaaauucagguuuugcccauguccccucucucacucucucccuccucucccccugccucucuuucggcucuuccucuaagggcuuguguuugucuccgguaguagugcuuuuauuauuccuugauguguuuucacuuggagcuaaguccugcaagacuuagcauaaccauacacauuccugaaaaaccucugcacuuugauccaaagggccgcgguuuaggugauguccaguuuggcugagaagagggguucaguugcagaauuaaagggggccugucugacuuccgggucuccccuuucccugcgugacuguuuacugugucgcuuuguugauagugaguuuugucuugguuaugcuuuuuccuuucuuaaaauucuugccaugggcagaucaaccccuuuguuguaagcuuuucucuugucuggguuaauugccauuucagaguuugagauugcauaauacuguggggaagcaguuggucaucugaggguuuuggcuacugucaccacacaucuuuuuugcugggagucacaggaucuuuacagggcugauauuggacaaaaaggccccuuacuaucagcagccaccauagaaaaccaaguugcucuggugucccaagaacaguaggggacuggcauacaccaagucuucuagcauauuuucaagcauuuaggaauuaaagacuacuuugcauaugagaaauuaguagguaaacacugccuugcucaguuguacagggacacaaauauaacacacguagcagagucuagauuucauaccuacauaggacucauuccacuccuuauaaccaaacaaauuacagaccaaauggcccucaaauuuaaucuaauuucuuuguuggaaauguuuuccuuuauuucuguguccaucaaugaaugaacugagcuaccauaaucucaguguuaacccugguccuaggucaggugcuggcagacugccuucuugugcuuuugcaaucuguguaacaaauuggaauuuacagaaaucuacguguggaugcaaauacacaugcaugcauaaaauucuguguacacacacgcauauauaaauauaaauauuaaguagauacccauguaaucuuaucuaucacacauauccccaguguuucuuaaauauucaguauuacugaguagccaagacuugcacuguaccuuuuaaaauguauuauggaacuugcuacacaaccuaggcugaccucaaacucauggagauccuucugucuugguguuuugaaugcugggauuacagaauaaacaccagugcccugacuaaauaucuuagagcaugacaacauagaacuuccucuuucuucuccuucuccuccuccuucuucuugcuaaaacuuuucaaauaauguauuuauuuucuuuuaugugcacgguguucugccugcuuguaugugugugagaggaugucauauuccaugaaacuggagaaacagacaauuguaagcugccaugugggugacaggaauuguaucugaguccuuuggaaaaguagucagugcucuuacccaaugagacaucucucuaucccucagaccuuccucuuucuugcauauacaucuugagauguaaguacuuggcuuucucccguuuuaguuucuucuguguucugccuccauuucuauacucucucaaaagacucucuaauuuaaacuccaguguccacuuugguauguguauucugcuuucauucugaauuccuuuacugggugauagcagcuagugcuuaaggaagagaugucugaaggcuaguuacaguugacagcuucugcuauggguucuuggaagacuagggcugacuuucaguauaucucuuuuccuuaccuucagagccuuauccugauacucaguacucaauagucaccaaggaauugaaaucacuuuaaaugaccaauucuucuccuuugguuaauaguguuuuaagaaagugaauuagagaggucagcaacuguguaccaacucaucuauugugaucuuucaaaucgacuugcuaaaucugcuucaauuauuucuaugucaagagcaucuuuccuuccauacccuccuaggaagacaauagaaaugaauaugaaagguuguauagacaaucuuaucuguuacucacgggaacaccugccccuggggcucucucauaggacauggaguuuagcuccaaaacagaacacagagaagccuaucaauugagugacauagagauacuuaagacacaagacccccauguaaaagggagaaacacaaauaaaaacauuugcauaaaaacgaaugaacugucuucuauuggaauucugucugcuuuguaauccucuccugguaaugcuggcuaauuuaaagagaagcuagaagaagaaaaacagaagcagccaagaaaaugugcugugcuauggcuauaguuuuaugaccucagcaccauuccagagcuacagacuaacaagugcacaguuaccauacucaagccacaagcgguccccucugcugcaggcaugaacuugguuucacaucuguggcccacgcgguggcaccagagugacuugcaaauguccugaaaggaagagagagagagagaaaagaaaaaggugaggugagacugauaguacaaaaaggucaaacagucaaagcuuugggguaagguauuuuacuaggggauggaugccaucaaccaaacuccucgaagguacaugcaaucugaguugguagcaguagguaaagcgauuuguugcagucaguagauaaagaggaagugucuguggaaccugcaugaucguguagguuguagcacugacuaaugucuggagcacuaacagcuggaccuaagaagaagauaggucacgugcacgcaugaguauguguguacaugcaugccuauaugugcauacacauguggaggucagugggccacuugcaggcaucaguucucuccuuucaccaugugaguccuggcaauuaaacucaggccauugggcuuaguggcaagugccuuuacccuccaagacaugaucucgcugggccugaggucuguuuucugaugacagugacaauauccuggguagcagaucacaagugaggagucaagcaacucugacucaggccauguaccugacauguuuuagaacugcuaccagcuacagguccaccuuucucuagcugucugucuacaagugaucaaauccaccugaccccaaagagccguucuuauggacaaaugacacaccacauagucagggaccauucugcuuggcacacauggcuccuaaugugguggcuauuauugucaccaucacugccacauucuuaaccuugugauuucccaguaccacugcaagguaauucuggcaggaaacauaugaggcaauuuaaaggguuuugaggcagccucucaacaaggguucccaucuauuugggcuuccauaccaagguacucucaagcugaaggcaguuuuugagcaagagaugugagguguguagguugaacugaggaaaaaagggucuccauggaaacaguucaagucacuccuaugaacuugguguccauggaaacaguucaaaucacgccuauggacuugggcuagaggcgccauccauccauuuggaaaaaagaucauuuggcuagugugcgucuucaaaccuagugcaguucaagccauaacagugaagacuaaauagguuugucuccuacagccaauggagagucaugacccguaccuauggcagcuaucaaaaugaucccagcauagagcaaagaaaaggagagaccaugaggagaaagggaagggguggagagggaggguggucuagacaccacagccaaagccaagccacagggcugagacaaagggcagcuggagaagaacauggagaagagcaggcaaaacacggggauuccagagugaaaggagacaggcuguacggacauguuauuuccccuguggugaagugcagaagucaaauguaauuauagccgacgacaugcuuuaacgaccacaaaaacccucugagaaaacucccuuucaaaguaaacaaaaaaugggagcuugcacuuuuuuuuuuugcuggcaccuccccuucucccuccccccuccaguauauucuacuuugucuuaucuauaauuaccuggacuuaagucauaauuuaagagaaagagaaauaaccauagagacccuaagguuucauguugccuggauaugauccucccaccucaacaagaccacauauuuaagcugugcuggcuggacuggguccugucauuugcugacccaugcucucugguuauauuccacaggaugaguuccuucgaguaaaauaugacauguugaagauguuuaaaagcuucugaaaacucaagcucuauagguuguauacguauccagaugcucacugguccuucuuaagguguacgaccaugcugacuuuaccuucaaaauaccuccugaaucgaaacaauuguucccacccccauugcugccacccuguccccugccuuuuuccaugugccuuuaugccauacccuuuuucggauggcaaguuguucuauuuaacuccaucccuacccagugaauucucagcaaggcacuaccuuauauaauggcccauagcuguauaugacuuuugcccuagucacaucucaugcuuuugagagucagauaugauaugugaguaucauaaucaauaacagaggacagucccaucauuauagaaaguuauacuggccagcauuaugagcuugagggagccuuucauguaagucaguaaguucauguuauuucuuugcucaaaccacaugaugcugucucacuacacucaauguaguccagaguccuuauccccuuccauaccagacacugaauccucuuuaucccucugcucucauaucuuacagguuaacucuugcuguugugguuucauucccuuggcugugauaaaaaccuccaacuaaaagcagcuuauaagggaaaagaugaguugguuaauaacaauuccagauuacaguucaccagagcaaagaagucgcaguaucaggaccuuaaagcagcuaguccccaaucaaaucagugaaagaaucaauguaucaauguuugcuugaucucagcuagcuuucuccuuucuuagaugcuucagggaucccuuacuagggaauggugcuucccacagugggcugagucuucccauaucaauuaaucaucaagaaauacccuucacacauccccaauagcccaucugaucuagauaauuccucauugagacucccuuucaugggugauucuauguuguaccaaguuuacaguuaaacuaagcagcacacuugcuuacagcacucuaucuacauuggcucagcacucugaaagcaccuggguugcuccaaacacuggccuuugcaucucucauucuauuuguaucaccagaaaaugccuaacucuuauuuccucccagccuaccaaaagcucacuuucagaacucauuugugcgugugugcuugcacauguaugugaguuuucaugugugucaaucagggcuucacauaugcuaggcaaaugcucuaaaaguuaguaacagcccagcaucacuaaugaaaauugaaucagccaccaccuaauguaccuuaaacccauucuauuccaaagucguuucaccaauaauuuguuuauaagguugugucuauaauauucuccauauaucaucaucuuccuuccuaacagagugccacuguuguaagggcaggguacaaggcagacuucaauaaauauuuucaacaagucaguaugcaaauuaaaaugacagacuuuaaaauuagaaaacaaccucauugguagugaagaaucugggaaucucacgaggagucuucaauaaacaugccaguugugguggugcacaccuuuaauucagcacucaggaggcagaggcagguggaacucaaugcuucugaggcuaggcuggucuacauaguaaaaauauaacuuaaaaaaaaaaagcuaugagucucuaauaaaauauaaugaaaaacucgaaaaacaaugaaauugggcacugcugagaauauugguucaagcaagagcacuuaucuagcaugcaggaagcucuaaguucaauucacuauugaaaagacaagacaagaaagaaaaggacaaaacaaaaauccaagucuuguugcuaugaguuuccccuauauuacuugaaugacucuauaccuguucucuucagugugcuuaaugggaaaaaugagacccaggaagaauucuucaacugaaauauguuguguuuaaucucuccacccaagcuuuuaaguggggacaguaauuaaaaagcagcaaccaacagauaguguuauugacaucauuuuaagacucuaguucaauccacuuguagccauaugcacccguuuuaagcauaugguucucaaagcucugacgaaguguauguaacagaguagacaccgccacaaaucaagacaaaauauuagucacccuucaaaaugacccucuuggaggaaaccacuguucagauagcugucagauauggcauuaucugucuguugcaggauuuucccuguccaaucauauuagggcagugggaggcuugugauuggacaggagaagggaggccgagcgaguugaggagacagagagagaggucucaggggagagagagaccuguaacagaggcuguggugguguuaucgaaagguuagaauaauuggguuaaagcuuuaucguuaucaauuggcucuggaauuauuguauuggcaucuuguaaauuguaauuaaauugauauauaaaucuaauugguuaacuauaagcuuaaaagucuuguuucuauuagguguugagaaggcuaaccagggguguguggggcauuauauggaagcaagaggaacuuggggaggggggcaucuuagagauagucuguugggagcccuguggccucgaagggccagcaaguuagcagaccaagaggcugagcaagugagaucaccuggcacaggggcuagcucuagagaguugucggcagcagcaggagugcgggagcauggccuagcacugccaagagucggcggggucauauuuuauuauuucccgcaacaucuguccuucaacuucagaguguagaauuguaccaaauagacucauggcuuucccccccccccaacauguaguuuuuaguucuuuauguuucuguguaugguuacuuuuuaaauaaaauaaacauaccagucuguuuucagccacugucuuaaugacauuugaugguugccuccagaauuugacccuugucaggcaagcaguagcugauuacacgacugacuaagucacuuuugucuuaagcaucuucuaugauuucacucagauuaaaccuuugcagggccuuuucuggauccaaggguaaagguauaaagauauagcuauuucuacauaaauccaugguuacauuccucaguguucaaaaaguucauucaaauauauauaaucaagucaacauggauugccauguugacucagaagccgggguuucauuguuuucuuuucuauugggacucuacaugugaucuuagauuaguucccuucaauggccuuacuguugaguucaaggggaacaauauuaaugccauagauuuuucuauugguauauuaaugaaacacuggauucagacaaggagagaucuagaaaaacaaacaaacaaacaaacaaacaaacaagcaauuacagauuaagaagaauuggaguauggcugcaaucaacuguauacauuuuuguuuguuuuguuuuuguggccaacuggucugcaacacaaucuagcuuuaaacuaugcaccuccuguuuugcagauaaaaggggcaagccaaacucucuguuggaggcgaggugucuuuagaucguuagaagagaaauaugguuucuuuagccaaauggcacagacaagcaaugcugggaauaccuuguagccugcauucccagugcuaugucacuuugcauauauguaucuggcaugcuuaaguguguaugcauguuggaauguggaagggcauaugcguuuagaggccagaggucaaugcugggugucuuccuuaacuguauacauuuuguuuguuugguuugguuuggggucugggucugggucuggguuugguuuugguuuuuuuuuuuuuuuuuuuuuuuuuuuuuuauuaagacugggucuccuacugaagcugaaguuuacugauucugccaguuuagccuaaaauauuuauccugccuucugauccuuggaauuacaggcuaauugacauacucaacaaccuggauuuuaaaugggugcuaaggaaccaacucuguucucacaccuuaucuaagugggaguauuuaaaacagcgaaccucgaccaacuguuguuuguuacaaggggaauuaugggggaaccuucuguuacguuagacaagucgugaguagguuuuacacaaacucaagcaagaaacaaguauauaugauuccaguauggaaccauaaguucacaaugguggugcauaagauggagcucaggggaaauaguauuuaaaugaucuuggggagaaagagagguaucucacaucucuagcaguacagaaugguuacauguuuaucauacagaagucagugagguauucuagaauaggaaauccacagagaacgguuguacgcaugagaaaggaaacauuaaauagaaaauuugaaggugcucagcaguuuagagcacugacugcucuuccugaguuccauucccagcaaucacaugguggcucacaaccaucuguaaggggaccugguaugucugaagacagcuacaguguacuccuauacauaaaauaaguaaauaaaucucuuuuuaaaaugugcuucuaacuccccagagaauuucacacaacagaaaccaagguauuuuuccugugaccccaguuaguucucaugugaguggggacacuaucauacccugggccuguccucacuaucuuccuuucuggcuuaacguuugcagugagauuauauuuguguguguguguguguguguguguguguguguguguguguguuuugugcgugcgcgcgugcacacauacauacaucaugcacgcucuggccauggacaucauccacauugugacgcagaaagacccucauuagaguugaccaacaucagugcaauacugugaaccacucccucaacuguccuguaaagcaaccucccuaugcagcuaugcaaccucuuuuucucccuaggcagcuaugcuuuaggacuuuuguuacagaugucaaagugaaauaccguuggcaaaggcagagaucagugugguuugcuacgcgaagaaaaugugaagcugggagaagagagagagugggcacaaguaaaaaaaaaauagucucagacaccucuuucuuuaugaaaacaucaggcacgcugguggcagugacguugaacaugaacgagaucaagagaagacacccuuauguagaaggaugcaacuagacccauagaacaaucucacaaauuagccagagaacuauuaccuucucuuuacagaugugggcaugcaggucaacggaggaugaauuauuuguccaagauucuaggcaaaguugaaauuagauacuaaccccaggucugccuuaacucccaaggguggaauauguguacaugugcaugcaagcuuuuuauuaaaaagaauuauuuuauuuaaauucucucucucucucucucucucucucucucucucucucugugugugugugugugugugugucuguggugugugugugcuugcacaugaguauaggugcuccaagaaacccaaagacacugucagaucucuuggagcuagaguauaggaaguuauaaggagcccuguguagguuugggaauuguacucagguccucuggaagaacaagaagcacuccuaaccacugaacugucccucuaccucuguagacaugcuuauaacuaccauguaacccugccuuucuaggaggaauggcaaaguucaugaagauuaaagagaaaagguugaaagcgcuaacaaugacggcacaaugaaggccuugaagauaaaugcaaaauauuuuuaaugggauuuugcuguguugaaaaaauguguguguguguguguguguguguguguguguguguguguguguguuagagcacagcagggcacuauguauaaccauuagagguguguccaugacucagguuauaagcaagauuagcgaaauaccaaaggcuaguucacagggaaaacaaacccacacucagaagccaucaaucaaucgcaccuucccccuccacugccaucauaaaccgucucuguuaacccagacuccccagcucccuuccagacaaccaggcaucucugagccggccaucauuuuaggucauuucauuuagaauuuucauuuccauccacuaugcuuuccagggucaacaaaggcugagauagcaucuuuaaaaauaugauguggcaccagaaaaugauuaaggcgagguucugacacccuccucacggccugacacagaacaggcgugaccccgguggaaugugacucauucacgagcucccuugaaauucuaaagggagccauccuuauuacaagcuacacacuuacaacgugugcauauucacugacugagaaagcuggugaaucucaagaugaagugaacaacuucauacucaggagacacagucuacaguuaauggguuacuucccccagugcugugauuuaacaggcaaauugaaaagagcuuuaaacuugcucauuuuuaaaaaccuaccacgcguaaacacuugccaacccaaagcccacgugucguggaggauaugcucaaaagaugcaucuguggauuaguuuuuuaguaguagugcuuuuaaauugcauuaacuucuauagcuucacgucaaaccugugacuggauagacaccguuucucaagaauggacuucuguuuaauaggcgaguucucuuucugcaaagcauaaaacuacagagauaccacacaagucaugacagcggcugcugaacugucagauggagggaaacugguauccagggaaggagaggaggaggcuuaacuuccacguaugugauuuguuuuguuuagauuucaucacuuaaaaguuccgugucuuuaggcaagcuggauaccuucucugggauguaggugaggggggagcacuaacuuuuacuucaaagugguuuugacgacggaggucagguacaauaaaucuuugggcagaaugccuuuuguagcauggagggucaugcagagacugcuggaaugaugaugguggcagcaauaguuaggaugacaguguagcuccugauccauguugcuauggugacggagaaggagcgauagggggaggagagggaagaggaaaaggauaaagaauggaagaaguggaggaaagaagaggcuaccaacugcuauuucccaugcuuuguaucuuccaccagacacuggaaaugaacaaacuuuaaaaucauggcacauucuauuggcauugggacuacaauguugucaggaaugggcuuccugacagagcacaacccuguuucucuuauuuguacauacuagaauucuguauuuucucacuuaucuuagcggcgaucuugcuuccuucccaagaguugauuagaaaacccugcugagacuaugaaagaggaagucaacuucugguaccaguuugucugcuguauugguuuucuuacacagugaagggcacacguuuauucaugucauggugauuuugaaacacaucgcuuuaaacuugaguaaagacaacaaaggccuugguuagcaggagucaucacucucagcuuuaccacgaggaguaaagccugccagugagaaguggaacauuuucuuccaaggacagagacaacugguauuuaaaccaggcggacauggucuaugggggauaagccuggauaauucauugacaggaaaauuaccacuuaauuaucaugccaaacaaaugacauuugagagauaacccagaugcuaaccuuuggccucagcaaaccaaauguuuauccuuuugguagguacaggcacauggcauauccuuaaugcaaguuagacaucacaaagaaacauaccuucauaaccccaaggcugcacagcuuggcuuuggcuccaaauugccacuuacauugcaugucggcaucauaaaucugucccgggaguuuguccggauauuuauacugucccguuugcuugggcucauccaccagacagccagccugcgguguacuacaucgauaacacauccuuaauaacagcucuguucaucugugaccuuuucccauuuaaaacugcaccucugugagggcagccaugcagaggagcauagaaugcuuagagacacaggcauguguuuaaaguuuuuuuuuuuuuuuaaaguauguuuuauugcaaagagugagucccaucuaaaagguuggaauguacacugucauaaaggguuuuauagggggcuggaaguucuggucaucuaacuaaugugcacuagaauuggguaggagauagaaguauaaauauaagaaaaaucucccgucuacagucucaucccaacaacacuggacuuuuuuuuuuucuucugagagucuacuguaugauuagcauuagcuuaagaaauuaaaacacaaaauaagucagacacaaaggaugucugucuucaugggguuuuaagugacgguauacuucuuacagauaggacuaagaagaaauaaggguguacguugucucaaauaagcuuuacaaacgaaaccaaaguuauagccaaagaaucaggagguucugguugugcuguuguuggccuagaagccuagcagucgaagcagggggaucagguucaaggccagccuaggcauauguaagagaccucguguaaaauauaagagcaccccauacaauaaacuuuaggaucaggggcagaagggagaaagcuccccugaagggucuugacaauaugguaaggauguuuuuuuaaccaaauaaucucacucccauuuuuuuaauguaaucaaacugugccaucacuaagggguuaauuagugauuaauuagugugccaucacuaagggguuaauuaguaugugauauuaaauguaaauguggagucagauacagggagguacuaucaacugugcauccauaaugacuuuauauaauucucauaaaccuccuuaaggauuaugagucccacaagggcuguaacgucaaugaaacuagaaaauuaaaugugcuuaacccagcagcgaagguaaugucaauagcugcuguagcuaucauuacuaugaaaaguccugaaugacagcaaugccaugacgguaauuuaauccaccuggaguugaucuugauuuaugauauuuacugagcccauucucacgugagguaggaaagacaaugucaaucccccaacaaugaaccuaaaauuaauauggaaauauaggaggauguggguugugauaaaucagcaaauaucuguccauuuuuuuuuuuuacuaugaguugggcaucagucagcuauacauacucacauauaaucugccuuguugaugcagcuuuucugugaacauuuccagcuaauacauaguagcauagguuugaacauaucaggaucaucaauuugucaugaaacgucacuaauaucaggucaaagagggagcaaucagagugcauauaucuauauguuaugucagaucuaugugaaucaauauggacuaaaaauauggagagacaugcaugccauuaagcaccgaguaauuuuuuaagcuuacucuucuuuuuuuuacuuaaguguaugugucucugugugcaagcauuuggcagaagucagaaaggggcaucccuauagcuggagccaugggcaucugugagccaugcaacaugggugcugagaaccaaacuccaguccucugcaagagcaacuggcacucuuaauugcugagccaucucuccagcccucaguucacuuuuuaaaaauauaaaucaaacacugggcucuccuaaguucuacaaaccgguguguuagauuaaauuaauuagccgguuaaaaaggcuauacaucuaggaguucuggaaaagagggagggagagagggggugagguggagagagagagagagagagagagagagagagagagagagagagagagagagagagagagagagagagagagagagagagagagagagagagauuaugaauauuagguuuuaggaucagaauggaucuaaaugugagucuugaauugggaguguuccagcugacauacacuaagcaguuuuugcgucuguguuccuguguguguuuccacauaugugagcuucugaaugucauaacccaagcaugcaggucaaaggacaacuuucaggagucaguucucuccccaucauggcacuccccaggauggacuuuaaguugucaggcuugacaacuuagcaagugcauuugcuugccacccaguaaggcaauacguggagugacucuagcaaaguaauaggacuucaguauauuuucaacaaccagaucauuacaauuaucaguguaaucauaguaggaauuuuuagucuuuuucuucagugagauaccaaaagguauuucuguggaguguuucccauuugguucauuuccuuuuugggugcuagaaguuaaaccugguaccuucguguauguaaggcuagcacucuacugauaagcucuaucuguaagccuccuuuucacucuuuauucuuugggcuggcccugaacuuacauucuaacccagguuagaccauugccucucaaucauucugucucagccucccaagcagucacaauggccagcccauccaccaggccuggcuugaauauuuucuuucauacccacugaauacugcuacagaacuggucacagaccccaggauuuuguccauuuuaccugaggaauuucuuuagauacugucggcugcaggacgaccaugaaaacaccccauuguuuccagucagugugggugacaugauguugccuucugcuuuccugcagggauugccuucaccaucaugaaccaugccaaagcugaaacagaaaggcaaacugccugcugugaacccguguuccaaguuagcaccagaaaaauggggggagagugaacaccuagacacagcagacacagaugggcaacagaaaucaugacaaaauuaguuacuuugaacugcuguaugauuucugcagaaaaacuccaagaauguuaaagacuuuauuauuuauuggccacaaaacugaagaauaguuuaucugcuguguauguaaaggcuaggaugucauagucaagauuucuuagguuagaccaauaagauggcucagcaguuaaaaacacuuguggcccaacuugacuguuggaguucaaucccuggaacacacaggaugcacacacauaugcacaaacacucaugcauacacacaugcaugcaugcaugcaaucacauaaaauaaaauuaagugaguaaaauaauaaauguuuuaaaaaagauuuaacugucuuaaagcuuagauagcuaauuucuaaaaauuaaaaauagccaguuucuccuguuaccaaugcuagaacuaugguacagaaguucagaguaaggagaacguaggcacaggagaaaguaauuauaagcccuuuauagauaguuguucauaaagcuaauaccauauauaucuucccucaaaagaugaucaacugauuaguuaaacucucucauucagauuauaacugagucuccucaugaagauaaagaucuuuacaaaguaacgaggaaaacugcucaaaacacaugagauaaaacccagaaccucccagcuuguuagagagcacuguaaaugguuucugaacacaguucuuucuaugacaucagaaugaugaaguccuuugcagaaaauaagcguuacaauaucauuucaaugcauuacguggggaggggggccuggaaaaaggugacacaguguuuaggagcgcuugcuguucuuccagaggacucaaguguggucuucagcgcccaugacaucaggggggucacagcugcccauaacucggauacccucuuugagauucccuaaagaugacacguacuguuccuaacugguuuuggaucuccuugcaugcaaagcaagcgcauugucucuugucguaggaagugcuacagaaugcuucugcagccaucuuuagaaaauauucaugaaacagagcacauuuugugauguuucuuuuaagagaagcaaagcacagagagauguuuauaugaaguuaccaugaauuuaaauuguucuuaaucugaucauuuaaagaaauaaaaucugccucuuuuuauuuucuuuuuuguuuuuuuuuguuuuuguuuuuguuuuguuuuguuuuguuuuguuuuguuuuguuuucaagacaggguuucucuguauaacccuggcuguccuggaacucauucuguacaccaaacuggccucaaacucaguaauuugccugcuucugccuccuaagugcuggaauuaaaggcaugugccaccacugccuggcuaaaaccugccucuuaagaguacauucauauaaucaguuauaauuccuauggggaaaauauaauauuauuauauaguuaccuuuugaagguagcuucuaacaaaugaggaugaauauacaggacuuugcugugagcuaugccuacaaucuugacauuucuuugcuaguguucuuuccaauuuaacaagcaaguggaagguggcuguauacuggauaguuaucaacgaacucucugggacuuagaggugacuauuccccaaagcauauuuacuaaucucaaaagacauuuggcagaagcauuucugcauucuuagcuuugcuaaacuaaauucuuucugccuacgcggggagcugaggggauuugagacauucuuucuaaauacggaguggagagauuaaagccauuguucaaggagcgggagcugcuuaauuagagccucacuagaaauuuuuggggggggggggagaaaacccaauuugaacucaauuuugaguuucaaaguuuugcauuuucaaaaguacuuuaauccaguagucuuuuuggaagauacuuucuuucugcuuauuucaaaaguguuuccgagaucucagccacuaucgccuucacuaauuucaugccaaaaaggccacaugccaaggucugaucuugaaaauguauuucacuucugcacauucugugugcucaugcaugcgugcacauacuugugugcacauuuguaugaaacccagaaguucaaguucagcucuggguccuuuccacuuuuguuuuugagguggcguuucucauuggccuagaacucaaguauuagccuccugcuggacagucacugcaccuugggcaucuucuagcuucugcuucugccucccucaguccugagauuacagcaggagcucccacaccuggggguugaaaucagguccuaaagcuuauauagcaaaagccuuacgaaucaaacucucaccccagcauccuaucuuaaccucuaacaccucucuuccacccuaccugaagacuauggcuuguuuuccuuaaugaguguaucagauuugggguucaagauaacuuucauucgugagcaagaaugguuauauuuuucauagccaguauuuugaaaacugaauacaguauaucauugcacuaguggggggguagauuuacauauuaguaugauuagcuuguuuuauaaaaggaugagccguuucaggggugggguggcuuaggccuuuagucucaguacuuggaaggcuaaggcaggagguucacaaguucaaggccagccaggggcauguccugagagauuguugccacauaauacaaguuaaaaaguaagggauguauaagaaucagaggcagcgaauguguuuacuacacaaagaggaaaaaguagaauguccuuuaaauaucuucaccaaagcaaaaccuuaaugaaaauaaauaacguagaagagaaucagggaaguaguguacaguucauuugcaaacccaaaaaccuuaaaugauguaacaugugauguuaaaaaacaaaacaaaacaaaaaaaaaccaaaagcagacaucaaugacuggucuucacugaaugugugugugcacaugaguacauacauaugauagaagucaggggauagccuugggcaucauucuuugguacuuuuuccccuuugcuucgaggcagugucucucauuguccuagaacuugucaaguagacuaggaugucuagucagugaucaagacuagugcuagggugagggagcugccuccauauugcugggugaggugguuugaaugggaaugguccgcauaagcucauauauuugaauguuugguccccaauuggugaaacuauuugggaagaacuaugagaugcagucuuauuggaagagguguacaacugggcuugaggucucaaaaggccaggccaggcccagauuuuuucauucucuggcucucaccuaccaauuggaaucucagcuuucagcuacugcuccugggcuaugccugccuauugccguacucccugccaugcuaaucauggccuaugccuuugaaaugcuuucuucuauaagaugcacuggucaugguguuucuucacagcaaugcaacagaaacuacggcacuuagauuauaagcgugcaccaccagaguuggcuaauauuuuaugugugcucuuuggaucaagauuacauccuuuuacuugaguggcaaauaguuuagcaacugaguuuucugcuaaccccuaagcccuuucagaguccacaguuugaagcucuaaacaagaugaaucucaugucguugauaugaucauuagaggaaggccaaaggauuacuuggccaguuuccauaaagaguagugaauuaagaagccacucacuugugcccugacucaugcgcaauggugaaggccaggccaaguccugugucuucauugaugguacagcuucgguacuuacugcacaugccacugauaggagcaaauccuauugaaagaucaauuucaaauauuaacacuaauugaguauauacauauagaguuuaguggauuaguacauuuaaggguuuucucuuuugcagaagaguaaucaaugucuuuauugucacaaaacuuuauaugacuuaucuaaguuuauuauuaguauaagagaaacugauauaaugacaguuauggcaagguauaaugcuaacuuaagaguaucucuacugucuaaggguaggauauacuuuccaguucuuuccugaccuuucucugaagcagaaaacacaaacaugcccagguaauauauucagaucaaauuuacuuuucucccauucacaauguagcaagugucuucauucucccuacaagaaccauuauacaaucauucccaucaucccuugcuucuaucuugaucaaccuuuuauauagcacacgggugucuuuucuuuccugcuauguccacguaggguuaaauccauacuugugaauuagaggcauccacccuagugccaagccaugagaucauccgggaagucuaauacucaggcacacauaugugccaugggugacauuaucauuuaacuaauauguuacuuaugccacaugacaaagguaaggaaggacuguagacuaggugauagaggucacagaugcuauauaaagaaaggggacuugguuaauauguggcacagugaagcugacuuggugucuagcuggcuguuuuugauuuugcucccaguccuaccuacuuagggccuggauauguaaaaguccuguguuuccuaauauaugguauuuccaauauauguuuagaaaacaccauauauuguacuauacaugcaauaugugugucuaaauuucaaauuagaaucugagauucaggcaguugaaucaguuugcuuugggcagcauaguccuaggccuggauguucacaauguguaugugaaugucuaagcccaagugacaugcuccuuaaagagagugaccuacggagcagaucagggacugauuccuagugguaugcuugcuguguuccagccuuuguuuauacguuugucugcgguugucuccucagcguaacuucauuagagaaagcuucacucauugguuuaugcaccgucugcaacugguuucuagcuaaaauaucagaugugaguaguugccacuuugcagagcauguuuacugcagaacccucuacagcaaaaguuugcagaucuugacaugaauaacccaauuuguccaaaaaccaaaagcucaauuccuacuaugaacaauacuauggaaauacagcaagcaaguaaaagaugcuguucuuauggugauaggcuugugccaaaaaaaaaaaaaaaauggggagaaugguguucuucaaagucaaggagcuugcuaaagaugccaccaaugaccagugacacguuauguggucauggugcuuauggaauaacauaaaacauguuuagucaaaugacugucuucaugucacugauuaucagcuggagcaauaaagaaaaauaccuacugacugauauauggaugcuucauagcacaaggaauccacuaaaguaaaacccauucuccacagaacaaggaaagcuauuccacaauuuaaagacuuaaauacagugaagcgucacauaaugacuucaggcaacagugggauauuuauacaaccaugguccggugggaaaauagugucuagggaugucccagccaucucagauucugugaguacacucugagacggccaaacagaaacauuaccucguaacacgguucucagaaugugugauugggaacgguaagugacacaugaguauuaucaguucccuuugaugagacucaaaagggccacacauccaucggaaaguugucaucccguccucccagcuagugaggugugcuugagagaucugggcauagcauaccuagugugucacaugguucguucuuccaggaacaaaugucaaauccugugaggaggauggcguggucgugucucuugccauucuuucccacaagagcugacugccacugacagaagcuguuuagagacuggucugcauggugauugaucagcaguccuuccuaugggaaaggugcagggauuaaagagugaugauugugccagaggagagaagguugagccuuuguagcuguggaggcaaacgcagaaguaucauguuucucggagaaauuaucaguaggaaaaaaagccacugagcuaagcugcaccaauuauauauauauguuuuauauauauauauauauaugguuuagguuaauauaaauuuuaaaguaagcuugaauuuucaguauguacuuucuaacuauauuguuacaauaaaaguuguuaauuuuuauauauuuauucauauugaaguucaauaguuucuucaauaaagugugacaaagacagcguccauaguuuacuucucugugaaguuugguaccaaaaagacuacaagcaaucaauaacacaaugcaaguuuaccaaauggcaaaccauuuacuaggcucucgagaguaaggcauuaggacuggagagacaaaggcucagagauuaagagugcuagcugcuuuucugcaggacccaugcacaauucuuagcaugacacgucaacucacaacugucuaugacuccaauccuggagggcccaacacacuauccuugccuguguguguacuaggcacacccaugaugcacauauacucaugcaggcagaacacccacacaaucaaauaaaaagagagaagacaaacuuuucuaaaacaaucauuuuuuuuucaaaaucuuugauuaggcuaaaccaaugaguugggucaagucaaauguuuuagacaguaauuuugccagugaaucagagugcugcuggcuucaguauccuugagcaguuugugaguggcacaccaaagcccaaguauuacacacauacacacacacacacacacacacacacacacacacacacacacacuuuuuaaaauuccaggauaacuccguaaagcgcaaaccccuguaacucuccacaccugggcaauuagauccccuuucuuccucuucucucugacucucugcgguucacauucuuuauuggaguuggaggugaagagaacaaacccccgggggcuuugaaaacucaucugccugauuggugagaucauagggaucccaacacuguagagcagggagugccaugcaauuuagcacaucauuauagggucuguuuuugcaauuugcccaauuccuaugccgugcaccucaccauaaucaauucaaggcagcuuaaggcuccuuuguuuauucuuugucauuccuaaauuggugcuugggagaccauagacuuacuacaagaauuguaugauggacuacuucugguaaauucucgaaaugugcuuacguauccacguugguguugguugguauagcugagcuggaaagcuccaucaacucuaaaaucuaugacuaaauuaaccuuuaucacaagaacuaaauauguaagaguacuuacauuuuguacauuagcaacauuaugcuuaauauuuacauacaacuauugauauaugcauaaguauauuaucuagaucaacauauaaaguacuguuuugugaugauuuagcucaaugacugaauugauaaaucccuuuuaaacugcacuuucccucaugagaugguugguauacuuucaaaacuuagagucaaaugaccauuucauguauugguuuacaguagguauucaacaaaugcauccugaacagcagaacaaauggaugaauaaacaaaguuuuccacuuacagguucuucuuccagcagaauuaggcucacaaccacaauguuuaugucgcuuccaauggucccaucuuugaacaggcuagaaaccuguugggacaauuaaaaccacauacaaguuucuaaagacauaauuguacauggaaagaauccaucaaauccauauugauauggguguagguuucaaucuuaccagacucaaaagugauuuuuuucacaaugcaaauuuuucaauaaaaaaaaauauggcuaagcaugagccauuucauccauaccaggaaaucuuugucuuagggguaucaagaggguuccugacaaugccccuuaccauguucaugacugugagaauguacguggugacgucauccuugccgugcuucuccaccaucuuggcaucugccacaacaagggucuccacauugagaccauuuugugacuuuccagcugaccgucugggccgcccugugccuccauauucgucaaagcguagauaggcguccucugcaggaggcuugggggcaucugugagagacagaagagcauuuggaaggaagaccaacagacaaaaucugggugacauaggcugagagagaugggaaaauggggaggugacacugggugucgcuguugucaccugcccuggggcuuugcaccugagauuuacuccacagaugcuuagcugcauggaugggugggcugauggacagguggacagauugguagauucagaaauguuaaaaaugcucagagguaaguaaaagaaaacaaacuacaaauuuagcuggcagacaaggcagcaaaggaaggaggaaaaaaccucauuuuuaaucccuuaauggaauauauugacucuguaauaccaacaaccaaaggaaacggcuggcagaauguauaaccaacugugccagcuccuguuuguggaaggagcccucaucugacuguguugaacagugugggaccugguugucaucuguggcuaccaaguuaguggaauaugguuggugaaaaaaggauccaaauauacauacauuuuauauauauauauauacauacacacauacauauauauguauauguaugugugugaggaucugaauucucauauauauguauguauguauguguguguguguguauauauauauauauacacacacacacauauauauguauauguguguauauguguguauguguauguauauguauauauuuuaacuuggucucugaaaaagaucaaauaucucugaagcaaugaaguaucuaaaaucuaccuuuccagcauugaaucuuaugacauuuacauacaaaugaaguacuuccacuggaaauuuuguuauuggaauugauacugaguuagaagaguaaauuaauuaccuuuccagaauauaacaggaaagagaaaaaaaaaaacaauucaacgguaguaguuuguuacauaguuuauaauugaagaugauaauguuuuacaacuuagagcuagauaaaauguuacuauaaauaauuuguuuuaaaauuuuuguuauuuuguuaacagauguuaugaguggugugugugguguggaagccagaagugacaauggguguaucuguguaucuuccuccaucaaucucagucuuauacauggaagcaggguuucucaguugaacccagggcuugccaauucaguucuucuaguugcaauuuucccaauagaucccguuuccaccuucuucauaugcagagauuacaugguauuugaggggaggggaaucugacauuuacauggcugcugggucugaauccuggcucucauaccuguuuagcaagaaccucauuauccugagccaucuccuuagcucuugcuuuugauuuuuuuuuuaauggcagaaucucauuuuuaauggcagccugggcuugaaucuccuacacagucaaaauggcuucaaauucuugauucucuugccuucugcuccagagucuuuggaucacaaguauacagcacaaaguuugcuuuaaacugguuuugaacauaguuggaaaaugcaaacuuacacuugguucuuaucuauuggacuuugcuagucuagaaaagagcaaaagagacuggaaauauggcuuggcugguucagagcuuuacugagcauauguaagggccugggcuugauccacaagcaagguuuguuuguuuuguuuuguuuuuuuguuuuguuuuguuguucaaacaggagcucguuauacagguuaggcuggccuugaccccguaauucuccuauuucacccuuccaggcacugauauuauagguauccaccacugacuuauaggacaugccuaggagucccuccgcucauuuccagcccccugucaagagccaauauuccggagaggucaccugagaagucucuuccuugggucucuagaaggaacacucagccaugaguuuaaucucuaauuuucuuuuuucacuauagagagcuggguacccucccuaagaucacaaaaacuaaaauaagauuaauaucuuugcuuaaaacugggagaugcuuaaaaaggaaaaaaaaaaaaaaaaaaaaaaagaccuguacaucuuuccuaguugaagcuaggagagccacuucuucaacacaggguccaccaauccuuuugcuaggcggcauccggaacaaacugcgcagccucacugaccugccaugucagcaaacccagcugccccccaagacuccccauugaggcccucuucagaauaggacaaggaaagucuccuuacauacauuucuugcgucguccacaaaaaugccgcuuuugccaccuucgauggcuguacucuggcucuuggcucugggaggcagggggagugugacuuggggagugaccaggauauguccgcugggagccaggguagucuugguaccaucugacccucuucucugcuguccuuuuguacaggacgugaggaugguggccugcaggcgagcuauaguuguguuccugggccagcagcugagguagcggugagaugaggaauucauugucucggguccuuaucagaccugacuagaaaaauccaaacacaaaaagcacacucaugacuccauguguugccuuguccuggguuuauucuuggcaucuuugcauugguugcuuccugugaggaggcacuguguacaauaauugcuaucuguuugccuuuuaaaaauugugugugugugugugugugcgcgcgugcgcgcgcgcgugugugaauacauaugugcacauucauguauguggaggucagaggacaauuuauaauagauaguucucuccuccugccauagugcccugggacugaacucacaucaucagucaugauggcaagcacauguaccaugcuaaggugucuuauugguccugccaugucauguuuucucugcaauauuaaaugcuacuguuauaauucaaguuuuacacagcagauaacaaagacuaaguggguuggcacucuaucuccuaaaucuauguuaaucauggggaacccaucaacuguauuuuuucaaauauauuuuaugguaguagaggguucaaauccagggccuuauacaugcugauuaugccauguauucuuaggcuaccuggcuaggcugucaauauuuuguguuuuuauugauuuauuuguguauuuauaugugguauauguaaaugugguuguguacuugugcacaugugugugugugcuuaugcacguguguaugcuugugcauauguguguacuugugcauguguguguauaugugugcaugugugugcgcuuguacacauguguaugcuugugcacguguguacaugugugcaugagugugugcuugugcauguguguguauauguauauaugugugugugcuugugcauauauaugugcuuaugugugugugugcuuguacauguguguugugugcuuaugcauguguguaugcuugugcauauguguguacuugugcuuguguguauaugugugcauguguguaugcuuguacguguuuaugcuuauuuguguguguacuugugcacaugugugugcugugcauguguguuguuugugcauguguaugugugugugccugugugugugcuccaugcaugcaugugcaggcuagugaaggaaaacguuggguacuguccucugagaccuggagugagacuuguagccaguaagccccccaaaucuuccuaucuucauacccacagcaguagaauacaaguacauaaagcuacacccagguuauuauaugaguguugggauuugaacucagguccugauguuucuugagcaagcacucuuacccacugagccaucucuccagcccuuagagcagugagugguucucaauugucugaacacuguaacccuuuaauacacaguucaugcgccgguggccccaaucaucaguuauuuuucacugcugcuuuaaauugcaauuuugcuacuguuauggaucacaauuuaaguaucugucuuaggcaaccccaaauggcuugcuacccacgaggaaccgcugccauagacugaugauguuaguaaggguuuuugaaggagcgagcuaagggaugcccugcuugaaugccuuugacugguagacacuaaugagaccuggauggaguagugaauauaaaaacagcuccuggcuuauguaguaagaacgaguccuccucuauugauuuccuaagugcuaagauggaggguagacuuacaaggauggcugcaagaggaaccuccaaucgccucuaagugagggcuaugcuaugucaauaaugcgucacucagaacgccaucugcuggggaaacauccacuuaagacauuccaaggauggcuccccacaagcaugccugcugggguucaagcacugacuaaggcaugcagaugugcuggcccuagcaccagugggaaucucagacauggggauauuacaccacugcugcugcuuuuugcuuuauccagcuuaugaaucugugcaugagacugccuuaccuucacaugcaaagagggggacuuggaccugccuugaccaccuugcaagacaagacaaaaaagguauggcuggaguccuuuguacuacugaggcuguagaacuuguauaaugauggcucaaagaacuaacgcaugcucauucaagccagcucacagcugcuaauguaugccaugugccauauaacagcgaacaggacacaccacgcaacagugcaagagaauugcaaagcaugggguuggcuggcuggguaagugggggguguuggagcaagggcagcuugcacaggaauacaaagucagcaccucugcuagacuuuaggaugcagucggguagaguggaugacugacguuggaguuuagcuguuugucagaguucaucuuugcgguccuaaaagaagccccagaauacaugcuuugguccugauuuuucugcccuuucaaaaguuugcugacuucuaagagguuacauuacagauauugauauacccagggccuggggacaaaaccagauggcucccuuugccaggcacacaacuggaugccuaaguccucauccuuucuagguacuggcauuuacacauaguccauagaaaagagaauacauucauguccucauggagauuacaagagaagagaaugaauaguauuacaaagucguaauugggcuggggagauaguucagucauuaaaguguuugcuaugcaagucuuaccagagucugagccccagaauaccaauuaagacaucagcaggcauggccacaaacucucaccaucucagcagagacaggaggaucccuagggcccauuggccggccugccuagugaguuccagaccaaugacauaaccugccucaagaaacgggaugauggcuucugagaaaggacagcugagauuguccucuggccccacauacauguacauauacacguacccccucacacaugaacacacaaauacauaaaaacuaagauaagccaaaucccaccauuccagaaacaccuucuaucauaucccucggacaaaucuccuaguuggauaugcauuugcucuguucucgccuccuacguuuagcucaggcaacgcuacuagaaacuuccaucuuuugccuugacaccuucuaccuagucccugacaccaccuggaauucucaugaaggauaaaucaacauggauagugcucucuaccauccaaagguuugaacuuucucacaacuggcuguuucauaaguuaguuucggcuuuugaaauuuuccaguaacuucuuugguaaccaccaguaggugucuccgacccaugaacauuaugccagagcuucauuggacuuuuuccuucggccauccaggugguuaguggaauguggcaaauguuaggcgcuggugccucagcugcucugucauaucuucagagaagcucugacacccugucagagaaggggacuaccuguucccuucccaaaggaucacaaaccacacaguccguuguccucccaucucucuccaaugaaagaaauaaaauccaagucuuucugcuucuaauauaacauaucuguaauaauacagaccccacacgaagccccaggguacuccgcaugcuaacagacaacaaauauuuguuucuuagucaacaaaugugugucagaguggagacuagacugagagcaggccaugggggcugugggggggggggguggggggggugggggggggaaggaaaccaggcuugggaagugaaaagaaaccccaguugcaagagcagguggaauccugggucucccuuguuuccugugcagaguacuugccuucaagccaugcuggccccuccucuaaacuacauguagacaaaagacaccauuuacagcccucccuagacagagaggcauuacugaaggaaaaaaaaagugccucaaaagcccuccaccuugcccgacuuccuuacuugguuuaacuuauauccuuaaagucauguaagugccuggacuggagugacggguuuggaaguuucuuucuuucuuucuuucuuucuuucuuucuuucuuucuuucuuucuuucuuucuuucuuucuuucuuccuuccuuccuuccuuccuuccuuccuuccuuccuuccuuccuuccuuccuuccuuccuuucuuucuuucuuucuuucuuucuuucuuucuuucuuucuuucuuucuuucuuucuuucuuucuuucucccuaauucaagaagacucuaggcugcucaaaggcagagcgggcauuucuauguugauacaucgauaaacuggucacugagaggcaggacagaaagaugugguccacuaacuagaguggggggggggggcagcugccgcggcagugaggagcuccucuugcugguugagcugagcugcgaggaucacacagcagugucaucauuugcugugaaacaauguugcuuuuauggagcgauguaaauauggggguuaaaaaaaaaaaacaacauuccugaugaugaaggccucuguucugccuuggcuucaauuuuccaggagucucaaacaccccuuuuacacuaaaaaaaaaaaaaaaaaaaaaaaaaaagcacaguguccccuuaagggcagugguuuuaucuuaucggauuuaaucccaucaaaggugccccuggagccuuccuuuaaucccaauuaccaagaaagaggcaggaaagggagcagagucuuagcaggccuuugagauguaacuuaaaagacacccaaauugaguuugugggugcuguucagacacuuaagucggacucgcccuuaaaaagcccacacccacaggagugggcccuaccccucccauuacuucucuuuauaccaauucccauccuucaaucuauguuaaaacauucuccuuaacaaacgcuggcuguacuuucuauugggucgggaauguuuuucgauguguaagucuagauuucagcuucucuugagugaacaucucugaaaagaacccuccaggccucucuaggagggaguauaaagcugucuccugcugagugcccacggcaacugaugggccugccuugagacaaaugccacuggaccuacacacuucaguucaguuugaagugucuaaaacaauucuucauagauagagggauugcaccgugcuagauaauuaagaaaggagaauauucuuucccugggaucugaugaaaagcaauguaauuuagacaaagacacaaacuauaguuuaaagacacaggccaagugcaucuaaauugaaucaucuaugucuugggagugugaagccuuuuauacuuaacuaaaucaaugcaacguucugccuaaauaugguggagagguugacugugguccccuguggcaucuaauucaacagaaaacacacacacacacacacacacacacacacagaggaagcuuguaaauauuacaaaugaaaauaaaauauucauuagugugcaagaugcaguguuucuuggagggaagacuaguauucuaguggagagagagagaaagagagagagagagaaagagagagagcgagagagagagagagagaguaagagagagagcgagagugagagcgagagcaaaagagagaaagaaagaaagaaagaaagaaagaaagaaagaaagaaagaaagaaaagcuuuuuugaggacagugaaguucagaccagaagacauuuccugauccaggcagagaaacacuggauggaaugcaggaauggacucgcacaacuaaggaaugaaaaagugggggcaagcaggaagguugggaccaaagugauuugcaaagccaauaagacagacagucuaggugucccuggacagagaggacaggagagguuuccaguauagugagcuggugacgucauaaacuauggaaggcgaagaauuugucaaaaugacaaagagauaagcaaaacaaaaugguauuaaucaggaaaaagaaagaucaguacccagcugucuuuucccuccacugagaaaggcagagaugguggcagauguggcgcccccuacuggacucugcagaaaggccagcaugcaugugguguguucuaguagaguuuucucugccucaauuguaaagagacagacugaaccacuaaauuuaaaaauaaaguacauauugaccauaggccaauaccauauuuugauaccuuauucuuuuaacuuuagauaauuaauauuagucaauaaaauuuuuugaaaacuuuaaguacuacauuagucaaaaugaauauaaaacaguacuucaguccaaaaaagaaaagaaaaagcagcaaaauuuaaaaaaaaacccacacacacaguauauuggugguuaaauuaauaaauuuguuuuuuaaauaauacaauauauuaauaguucuuuuaagagaggcucaagguuuuaaaucaaaccuuuagucaauaaaauuagcugucuauacguauauaugcauacaaauguauauuauauauuacauauauuucacacacauaauauauauauauauauauauauauauauauguauacacauauacauauacacauacauacauacauacauacauauuaaagcuucagggaaaauacauaugcgcuuucuccgaagauuagauuucaauucucuuagaagcuuuaaagauaagaaauggaagacuccugauaaaguuaguggugacugggggcuuaauuuaguuuugaaagcucaguguggacagccuuaaagaggaaugcaaguuaggaagcuguaagcuccuuucucaauucauaucccugggccuugagauacccacccuccccccacaccuaagaacaccuuaauggacuaaugaugagcuacagcugaaacagagcugcagaugaaaugaucgcguagaccuuaaacaagucucuugaaugacaauaauaacagucucacugguaguaucauuccacuucaguguuuacugacgugugacugaccgguacaaccagacagcucucagaagacucaccggaaaauauuagcaaagacuaccucuguagucaucaccaaguuugauuucacuuuuuaauuucauucgagccauaauaacuuuuaaaauguaguuucuucaaccaagauggucuuuccuuuaacuuguuaagauuuuauuguauauguaugaguguuuugcccucauguacaccgugugugugugugugucugugugucugugugugucugugugucuguguguggucccugcggagggcagaagagaguaucaguuccccgggauuaugguugcagaugguugugagcuaccacgugggugcuggguauuacagcugguugugagcuaccaugugggugcuggguacugcagcugaguccucugcaugacuaacgggcgcucuuagcccccaagccaacucuccagcacccuauauggucauuccucuuaaagauagaucauuugauccaaaccaucguaguaaagaauagauaacugauucuucacugcccaauuugucuagucaugcuaaaggcaauuuccuagguuggauuaaaugaaaggcuuaggaaaaaagugguuaguauugaaauaaaaaucugugacuuggaggcaggggagaaagaaaaguaaggagagaaacccaggucugcagagcaaagcggcaaccgucgcccgagaaggacagccucuguggcaugaggauguuuauggacuuuugcccagaggcaagaagauuuacugaaggauuuggguggaauggcacagacguaaacaguucaggaagauuaucaagagaacggcagggcugaaaggugauguggaagggucgcugccccuucgaugggcucgaggcucuaagugucugcugcuguuuuuaucauuuucaucuccuauucaguaccagaacucagagcuucccuggguggaauaaguugauccuuagccagaguguguuaugccaugagcuuuuuaguauauagucacacaaacacacacacauacacacacucacuacacacacacacacacacacacacacacucuugcuucuggacaaaaauccaaaaauaucauauacauauauacauauauacauauauacauauauacauauauacauauauacauauauacauauguacauauauacauauauacauauguacauauguacauguguacacauguacacauguacauguauacauauauacacauauacacauauacauacauacauacauauauacauauauacauauauacacauauacauacauacauacauauauacauauauacauacauacauacauauauacauauauacauauauacauauauacauguauacauauauacauguauacauguuuauauguauacauguauauauguauauccacuccaguagugacaagcacaacaggccccugggcgcuguccugaggcgaaaaauucauggaaacuuagucuccuggaaucguggcauccuguauaaagaaugcuccaauguccuugcuuuaguugguaaauggaucuguguucuuucccuuaauauugcuuuauuacaaguguuccuaaggauugauauuuugacauauagcuaaguuagauuuuaggcaguccuugauccgaccuuggacauggauagcuaagucacugcccuacacagaaauuuaccauuaucuaggaagaaggacguuugaggaaccagaguagauacuuagaacuauagguagcugaguuacacccauacacaaguauuuacaauggccuagggggaagguggacuauacaauagacuagagugggaacuauggcaagggcacgaggcccuugccccuggcuucuaagauuaaguggaccuuagguggagcuguuuuugaucccaguuguuaacauugaguuuuaccccaguugguuccugccaguucuuccauguuuauauuccucuguuuuguguaagaauccaguagccucuuuguagcuugcaggugugucacccaacuucccuauuuucuucuguauaaaaaguuugaugcuggauuugacaaauuacauucagauccagcacacucucucgugugucugucaauuaccgccgauucuaugcccaucuguccaaaccccugguucccacggguugaggggggcugauuaagcccaauccguggcauauauauauauauauauauacacauacauauacauacauacacacacauacacacacauauauacauuauacacauauauagaaauacauauauauguguauauauauauauguucauauauauauauauauauauauauacagagagagagagagagacagacagacagacagacagacagacagagacagacagagacagacagcgacagacagagacagacagagacagagacgcaauggcucucucugaagaaauaaaaccaaaccaaggagaugaggaacuguggugagcugauucaccauaaacuguuuacugaaucccaggaaagaacaagaggguucaucuggaccacugcuugggcugagaagaggacaccugcugauguuaugcccugagauaagcaacauggguagcuuacuccauuuucuacaaagcauauuaguucuaggagaucuaaacagaagcucugucauccacacaugcagaggcggugggacagaugaccuaagcaggcccucagguguccacaugcauuccagaagagaugagauacccaagauuccagguuguugucaaugggaaaaauaucucccauauuuuuggagggaggcaggggaaauguauauuuuaacaaaauauuaguauuccccguccauuccauuaucucaucauccaugggauggacucacaaugcuauuuagguggagauuaagaauuuccagauuugggcgcugaggggaagucuucaugaguaaaaugcuugcugccucagugugagggcccaaguucagauuccuaaaaccuauaugaaguaggugugguaguguguaugggcuauaaucccaguguccccauagcaaagacuacagaauccccaagggucacaggucccugauauuuacugugguuaacaagggacucugaccuaaacuagguggaaggugaaggcugauacaggagucuauccacacaugcaugugcgcgcacguguguguguguguguguguguguaugugugugugugcgggcacgcacauacagaauuuccagguugguauacuguugggugaucucuugcuaaugugaguucauugagauuaacuuauaagaucauggaugauacacuggcagcuauagcaccagaaaaacccaacgcucaugagacuugacacuugcuguaaaugguggcaucccaagaccauguccauccagggaagaagaaguaacuagaaucucuggugagauuuucaggacgcucucuccaccuucauacuaagaggaucuggcaacaacuuccucgccagcccccuugucggccauucugguccacgccaugacuugacugugggccaaguuacuccauaguuuaccaugccagcucuacuacauaaucaucaagauagagauaauauaucaaacauggguauagagacaguaaaguuccuuccagaagcuacuaggugcuucaauuaaguauacauugucaauaccgucaauaacacugucaauaguuccuaaguguucuuagcaaugcaaagauagugagaggcagaauugucuuagauucuccaauguucaaaggcuucuuaauccuuucccuuaucuccuagaucuucucaaaucucuaagaacucaagucccuggucuguaaaaugggaauaacaauagcccuccccuuagagaauuacaugcauuaagacuugugaccuguuagcgauggcagggggcugguacuacauagcaaguauuccuauaauuacuauauuugauagcuuggggacagagcaaagaauucaagccagaccuuuucuauucuuuucuuauggugguucugugugauuucccugcucugugcagcucagucuggccucaaauuuagaguguuccuccugccucugccucugccucucacccguguacucuaucccacugaucgcuagcauuacaggacugauauaguacaccugcuagccaggccucuuccuaacuaugucacgcuuaggauuuuccucuucaauuagaccuggaauuguggagacugguauaaacauccuuucuguuuauugggagagauaacggagggaugaggcaagacuucaagaccugaguagaaaaggaucaaugaaaaucuuccagauauaacugaagauucuaaaagauggagaagucacgacuauuuccacuuuggagaguuucuuacgugagagaggagguuuuaggguucauagacugguugguugguuugaguuggaauaggacagugguggguuggaaagacguaguuuugguuccucaucuuguauagccaguauggacauuaacuucauauucacaguauucuggagaucagauguuuagauguuuagacuaacuuguuuagacucaucagaacacugugggcuuucuggagcaggagacaguggaucgugacuauagacuagaaccccugagucacacacuggccaucuguucagaugaagcaggcuaaagcuugccccuuccacagaauaccugguaagcugagccaucucauaccugcucauggaccacucugccuguuauuugcucaggugcaacccuagauaaaacugaccucucuguguaacccuugaccuucgcaggguaggucacauugccauaugucauguugccauacucacagugacaaggaaaacaaggaaaaagucacuaagccuucuguauguauuucuucugaagguuucccuuucuuuucuccucucaacugcaucacagaaugcucuauccuucugcuguacuucauuccagcucaaaucagugccaaaucacaaugaaccaacaugacuuugaucucauagaaaacucauguccugacacaaaggugaacaaguucuggcccuuuccucaaaguuguaggaccauagcuaucugacugguaaagguucagucauuguaaaagcucauaaugcgugcuugucagcgcauuguugcagcuaauuaugguauuucuaauggaauaaacaguucacgucuacaacagaucaaaucccaugacaccagauuaucugcuauauccagaagccgagugauugcacagcguuuugucacuccuuuucuuucuuugagacaggguuucuuuguguagcccuagauguccuggaacucacucuguagaaccaggcuggccuugaacucaaauauacaccugccucugccuuccaggugcugagauuaaaggcgugcgccaccacuaccuggccuuaaacauguauccuaugagaauucuggaggaugugacucugaggaagagacagccuuugaagugucagacuuuuuaaaaaguaaacuacaucuggacugcacauccagaguccuaacuacuggguauucuugucacuucaaacaaaucaggaagacuuaaagacaaguaaguauggaucugugucagaaugaagagaugcuaaaaccugaagguuacucuucucucucuucuccuugauguuuucacaucaagaggcaugaaggaagaacagcagguacuugagguaacauuaagacucuucauagauccagagauagugggcucacugguucuagagaauacagcccugacugcucagcuugaugacagccacaucauauccuacaaguccuuuuugaaggaauuaagcacagagaagaguaaggagaaaaagcuauaccuguccaggcccuguccacuuaacacagucuagagucaucugagaauggugucccaaucaagggguuguauaaaucagauuggccuaugagaaugucuuugggagaccaucuugacuguuaauugauuaagagggcccagcccacugcagggggcaccauucccuaggcaguuggcccagggcugcaaagaguagagaaauccugccagagagugacauguggauguaauguuaugguuguugaaaguucuugaugcugugccuuccucauagugauagguuauaugagcuggaacaaaucccucauaacaccccccccccugccgccuuguugcuuuuugucagaguaauuaucacagcagcagaaaugaaacuagaacaaaaggcagaaaaauaaagacaucgagaucuacauuuaaggaguggugcuacucugggagaugaacacaagcacucaaucagaagcacccacuuucugcuucaucguccugauuuacagauuccucccacaggccauccagucaucccgcacuaauggaggaggugagggggaggguggcuauuucucuaguuucuuucuaauccuuguaauauaaaucuccuaguaagacagggauaaguggucuugauuuugugccuuagcauuugacagagcuugggcaugaugcucaaaguuugcugaauggaugauggcaucuauagaauucuguaggcagaucuccucuaagggucugaauucuugucugaugggagaccagcagggagcuuugaaauguugcaagaaucaauuuaugcuauagaaagcccuggcagguacccacguuccugggauccucuuacacucccccccccgccccccccagaacagugaggauacacccuccagacacuaucgugaaaagugacagaaacuugcauaaugagcacacaucgcccaccauccaguuugcuaggccuuacuccuuguaauucgacaauaagcgguuuauuguugguaccauuaguuuuuaaauugcacucacuuagcaucuaaguuuggaggacggaaauucccauggcuggcagucaauaugagcugccucaaaacaguuacuuuuucaagaaggaagaguugauacacacuauccaucucagcuggaacuuuguauauagcaucugcuauguuugcaagauacuggagaaucggucucggaaccaaugaugcuccccguucccaaggcagcugccugcugauacaggacuggaaagacauauguuuucacuuguuucuguaguggugauggguuaugucaggcucucugccccgcccugcccugcuucccuuggaacugacagcauucauuuguuaaacagacaguuaaagcuggaaaccgcgccaguaaccagcuguuagacaugggaggaagucuacuacguggcgucaacucacuggguagcugcaccgaccgaccgggcuaugugauugacugaacucacaagugcucccacgggugguaugagagcaccugagaugacugccaugucggagauagcuggucuuaauuuucaucgguuauuuaucuucugccccucugcauccccugccuuaagguaauccaaggaaaauaaucguaggcuuaagggauauuugcaauuguguaguccauuuccccauuucucugaggcaggaaaugggauacagggagaauaaagaaugucucaacaggucaaaacugauugccaauauaguagaaccuuguugucuacaauuccauuuucuugucuauuuaguagacaaguugggcuuaauugaauggcccaucuccaucuuaaauucaaguauuuucgaaauucaggaacacaaacagguaacaagaugaugcaaaauaaaccuuaugaucaaggcagggagcuccccguucaaagucccccuccucccacccucuccagagcccacagacuuucaaaaucugugaccuuuguccucaugcaacccugcauugaaucucuuauauuuaaugcaugccuggcuugccgagucaaggcggaggcauuuccuuuucugucucuggcaucugccagaccacguggcagaaagcuaacacccuggguauguuacauauaaauguaaucccuaaaacaccuuggcauauguacaaggaauggauacuaaggaaaggaaagagagcugagauuuugagucuggccuuagauucaaauuuugacuccacuccauaaggaucucuggcacucggugccguuugcuuaagcugcuccuuuuaauauuccuuggguauuuacaugugacucuccaaaaagcaggcugcuugguaaugggccuguguuauguaaucaacgaacugccacuguaaacaggagcaggccgauaaacagaacuuucuagaaagcugaaauagaagcagcguuuauuuaaccuuguggagucuguguguuugcaaauacugggggcuuucacgcagaaacaaacuacagcagccuccaagcagcgggcuuuucuguucagugacuuacacucucuuguagaucaucaacauuguugcuccaggcagagguugggagggaggggucuagcuggcuggcagaaccagcacagggccacaugcauuaaauuaaaccaguauccuccaucccgguuuagguuuagaaagaaguuaacgagguauguuacagaaacucgaacugaagccacuaauacaacugaggaacagcuggcagcaggcagggaucuccaggcuuuuccugaccccuguuuacaaagacauccucauucagcugucaggcgaauucucuucagguuacaagcacaaaguagcgggagaugagaggagggguggcuuuguugauaagcuuuggcucacgucugucucgggucauacaauuguauaucaggcuguuguggaucaguuuacaugacuuuccucccuccccuuauuauuaaaugguucaggucaccuugaucaugggauaaauuguaucuuaacacaccggauaagucuuggaagaaaucucaaaacacaucuuauauaagaguauauccacacaaggggcagggugugagugcguauguggguacauggcuacauacacguaugugugugaaaugcaucuagaaucuagagcaggaugcuguguagcaucuccuauugcuuucccccuuacauugugagacagagucuggcugaaugugccacucccuguuccuggaagacuagcuggccagcaaggccaagagacucuccugucucuguuuccuuugugcuggggauauaggugccaguugucacaccuagccauguagaugcugagaagcaaagcucagguccccgugcuugugugacaagcacuuuacaaaccaagccaccuccucaaaaaccccuauuuucguacucugguguaaaaugucacagggggauugcuucugcugccauagcauucauuuagggagaauuauaagcugcauaucaguggcuuacuauggucauauuaagaagaucggcaucaacaguaggugguagcacacgccuucaauuccagcacugaguaggcagaggcaggcagaucucucugaguuggcagccagccuggucuacagaguaaguucugggacaggcagggcuacacagagaaaccgugucucaaaagacagagagagagagagagagagagagagagagagagagagagagagagagagagagagagagagagagagagaaggaaagaaagaaagagagagagagaaagcaagcaaacaugaguuaguacaaggauacugaguucuuuaucugccguaagcaagguuucauuagauucucuagccauagcuaagacagcucaugaccuaaaaugacagccaaugucuuauuuguccauccacacguggggugugaaccaagcuggcccuuucuauccagcaguguguuuaguuaguuagugaugaccacucuccuuccaacaucuauacagcuugaauggagaguagccaggcgccugcucuccucguuuccccguccucaucuguacccagcccuuccuuauacuauuguccaggcugccggcuggccuuuccggaguucuuuccuaaaccggguggucucuggucuuuuccagcaggagcacagcaaggcuggguucccccauguggagugcucuccucagcuaaucacaaacacuuauaacuccagacaguacugcagccgugccaaaagccugggagucaacccuuaacugugcugcuuugaugaaccgugaacccggggaguuaucgacugugccucaguuucuucaacaagcaugugugccaagugaagggcaucagcuuguucuagaaauuaaggagucaauuaaaauauuuaaaggaaugcaaaucaaaacaacccugagguuccaccucacaccagucagaauggcuaagauuaaaaauucaggugacagcagaugcuggccaggauguggagaaagaggaacacuccuccauuguuggugggauugcaagcugguacaaccacucuugaaaucagucuggcgguuccuuagaaaauuggacauaguacuaccggaggauccagcaauaccucuccugggcauauauccagaagaugucccaaccgguaagaaggacacaugcuccacuauguucauagcagccuuauauauaauagcuggaaagaacccagaugccccucaacagaggaauggauacaaaaaaugugguacauuuacacaauggaguacuacucagcuauuaaaaagaaugaauuuaugaaauuccuaggcaaauggauggaccuggagggcaucauccugagugagguaacccaaucacaaaggaacucacacaauauguacucacugauaaguggauauuagcccaaaacuuaggauacccaagauagaagauacaauuugccaaaugcaugaaacucuagaagaaugaagaccaaagugugggcacugugccccuucuuagaauugggaacaaaacacccauggaaggaguuacagagacaaaguuuggagcugugacaaaaggauggaccaucuagagacugccauaucuagggauccaccccauaaucagcuuccaaacgcugacaccauugcauacacuagcaagauuuugcugaaaggacccagauauagcugucucuugagagaugaugccggggccuagcaaacacagaaguggaugcucacagucagcuauuggauggaucacagggcucccaauggaggagcuagagaaaguacccaaggagcuaaagggaccugcaacccuauaaguggaacaacauuaugaacuaaccaguaccccagagcucuugacucuagcugcauauguaucaaaagauggccuagucggccaucacuggaaagagaggcccauuggacacacaaacuuuauaugccccaguacaggggaacgccagggccccaaaaaaugggaauggguggguagggaaguagcggggagggaaugggggacuuuugggauagcauuggaaauguaauugaggaaaauacguaauaaauaaauaaaaaaaaauaucuaaaggacacgggcaagcaccuucugcacagccagggugugaccucucuguugcuucuuugacugaaaacacaguaguauucauuuuuuuccucucucuuucuuucccccaaugcuauggauaaaacugaaggccucucugacaauagccacgcccucuaccauggaguuacacucccagccuccuuuucccauuuuguuuugagacaaggucuugcgaacacacggaugcugguuuugaaaacguauucuucuugccucgggcuccccaguagcucagcuuacuguccugcaccaggacaaaaaguggcaauauggugauucugugugugugugugugugugugugugugugugcaguacaaaugauaaauuauaauucuauaguaaauagauaucaauggucgacaguaauccaaaaccaaccucaagcccccagacugagaaauaggugggugaucacaggguguucauagggaagggcauguggcacgugugcagcauacauagacacauggcuucgugaccauugcagagguuaacagggacaugugcuugauggccugcaggaagaggggacccaguggcuauugggggaaggguucggagagaagggcucugaucuucuccagcagaaccaccagccaaauauugugauucuuaaccgacuggggagcagagaggcaguuaccauguaaauucuagcccaguguuuucaacgauaacuccccagcacccacgacccugucuguugaauaaucaauucugaauaaguagguaccaauugaaaaugggccacggccagacagcgcuuccgaucagccacagcuucuaauaaaguuguuaucggccaacaaagugucauuaccucuaggcauaaaguuggggaugaaauuuaacagugaguacggaguagcccaaacucaguguugauuaccgcuuacacagguuuggucuuaaccuucuuuguucuuguuuucuuucuuugcauaggagcugcagucagaacccccaccccaccgcaccguaccccacccccaugccagcaugcaauugucagauucauugguggaacaaauauucuguauuuguaguggauuaagcacuggguuuaaggaaugaaaccuggcuggggcuggccacugcccucaggguauggggauucagaccaaagagaccaagaguuaaacagaaauuccucagcagcccccccccuucugcccaccccgaaccacccaaaagcuuguaagaccaaugaagggacacuaacaaauuccugagaggguuucuuacaaagaggguguguguguguccaaacagccuuuaaugaggcuagaacuggccaggugaaccagaaguggaagaggagggccaggugaggaggcagaggugaaaggcagagggguucagugcccugcggccaucugacuucucaagcauagaaaggguaugugcacugguguguaucugcuauugggaauagaaaagaaaaugagagaagaauuuucuagaagcacuagcccuuuauaaaggcaucguguguauucauguguaacucaaaguaaaaauagcauuguuagcaaauccuugcacucaacugacacagaaguaggcagaguucuauaacugguuaugaggcucccaaaacucugugagauuuguuaagacuccaaagggcacugggguucagugugagaacagugcagacacagugggcagggauuguaaagaguggcuguugggcugaagagaugauaggggaguugagaauucuugcugcuuuuccagaggaccuggguucagguuccagcacagaaguaggaagguucacaacugccuguaacuccaguuucaugagaucugaugccgccuccuggacucuacagguacuugcauacaugcucucucucucucucucucucucucucucucucucucucucucucucucuuucucucucucucucucucucucucucucucucucucucucucucucuuucucucucucucucucucucugucucacacacacauuuagaaagaacagcuguaguugcaagucaagggaagacacacaacaacaggaagugaaaccgagaaaccaucagaaauugcuuggguuuccacaagagacaacaacagaguaaaaggcaaucgucaauggucaagacagagugaagucaacaagucaacaagagagaaggacucaccaggauuuaacuaugcaugauggguaggggagagaaaagagagagaacauguagaccugaaccuccagucccaucuuccaccaccuguaaugaggucacaaagccuggugauguccuguagacaauccuauacuacagcagucagcaguuacaggcacacuuauauuuaauuagcuaggcugaggaucuaccucagagguagcauggcuaacaugcacaaaucccucagguguaccccuagaacugcaugaaaugucuagcaauguuaauguuuccuugacauuucucccucacauaaucuuagcauuugggagguagagauagacgguccuuagcuacauagugagucugaggucugucugggcgacacgaggcaucaucucaaaagaaaauugaguugcuuacaugaccuuaauaaaaaaaugauugguugccucugucacacacuuccagggagcuaugaccauaucuaguuagcauagaugacucuguuggauagaacucuguuaaauugguacuaauuacucccgugacaccuguacaugccacgcggccacuucccauugguucugccaaagaacugccgacuggccucguuauucaauuuuacuccccccuuuaaucuaaaagcuauuccaccauuucuagaaaucagaaaaucuauccauccagaaaaauaaguaccauguaggucucaggugucccuugguagucgaaagcuuaccuagcacguggaggguucuggggcuggccccuagcccugaacaccaauaagguaagugcacauaugcuuugaauaagaauacagcagauuuacacaccaaguccuuguaauggcucagucuuacaugauaaggagggacuggagcauaggucaggagcuagagugcuugccugaaguguuugcgaugcuggguuccaucucugguauuguagaccuggccaaggucaugcaugccugcaaacccaacacuugagagaugauggcaggagaaucagaaguacaagaucauccuuggcuacauggugaguuugagaccagccugggcuuauaagagacacagucuuggggucgggguggggcugagccugggggugggggguggacacagaagcagcugugcaaacaaacugggaccuuguacuaguugcaaguaauuagcaaguguugcugcgaacauagcacuggcagccagggggaccaaggagucagcaacagccaagcaucucccuuuuauaauugcccagggcucucuggacagccucgucugcugggguuggaaguaaugagauuaagacucuggggacaccagcugccuugacucuggucugaagagaaaggagaggccugguuuucauucugcaaggggugggccgggagaccucagaaucgcaacagagaucaagaugugacccugacucuucaauuuucucucuuucuaaagagcccccugggagagcccucuccaucacaggaagaagggcaugcugaccuugaggaaggucauucacacggcuguuaaccuaagcaacgugcaccucugcaauauuuucuccacaagcaccaauagcaggaaaaggguugugcaauccagucugccguccuguuacaagaagcgauuguuucauugagugaacagguacggcaagccaggcacacauggcaaaggggucacccgcugugaagggacaucccucccuccuuucucaggacccuugggugucuccugugaaacugaagcuuucacuguggccggcaugaggaugacaugugaguuccaugaucauuacacauugcaugcacccucugcuuuagacuccaccucucaggguccauggugcaucagcuggaacagucugagggccaauccuaaaacaccagaauugacacaccacgccaccguggaugcucguuucuguuuccucugugccacaacaccguggaugcuugcuuccucugcacagggugcuuuucccucugucccuuugucccucuguccacucagagcccuuuccucccucccacucacaugccacucuuuguaagaauuuucuagaacauccaauauacaauuccuauccugcuucuccauggcuggugacugacugacuuuccuuaacauuucucccucacauaaaaucuuaguaccuaugucuuauuuccucacccuauagcaugagcuucaggcaggcaggcgggcaggcgggugggcaggcaggcagacagccaagcaggcgggcgggcaggcaggugggcaggugggcaggcaggugggcaggugggcaagugggcaggcaggcaggugggcaggcaggugggcaggcaggcaguugggcaggugggcaggcaggcgggcaggcaggugggcaggcaggugggcaggcaggcaggugggcaggugggcaagugggcaggcaggcaggugggcaggcaggugggcaggcaggugggcaggcaggcaguugggcaggugggcaggcaggcgggcaggcaggcaggcaggcauuucauccuacccuguugaaucccuagcuuugggucuacaguaagcacagcaaaugcugaucuauugaguaaguggcucugcccugacagaauuuauaugacguauagcagaucccugugcaaaaagcacucuauaucaaauacucuuuugauauaauaaggauguauuccauuuccauugaguuuaaucagaagacaccaaaaaaaaaaaaaaaauuccaacaugugugggcuggcagauggaauuuuuagccaggaugggaagucccaaguggugguuuaaggauggaguaccauuggggaggugguuaagaaggcacagaaagaauuugugcccauuuaagguggggggcugccauauccuauucuacucaauacagaaagaaaccacaguuugaaauccagagaggguccucuccagaaccuccaggucucugacucccagccuccauuaaggaaaccaaaguucuguugugaguaacguauucaagccgucugaaaugccucauggaccuauuguaaucaagucaccucuaucacugacucuuuccucucuucaaacauccucugaaaggggcuggggacaugacuuggcagucaaggccacuugcccuucacacagaggaccuggcuucauuuuccagcacccacacagcagcucacaaccagcuauaacaccaaugccagagcauaucauacccuuuucuggcagaugcagacaccagacacauaugugguaugcauauggccauguagaugaaauacucauacacguaaaaacaagagaagucucagaucucucuugacagaugucagaggaguuggcgucauuauaaucacccaacaagauucacccgguccuuucuugccccacuuuuguuugucccugaccacgaaccaucaugugguuaguggaauuauugcugcugagacauuagauucagguuacccggacuuuacaugauuaaugaucauuuugguuuuagagaccugagaaaucuucauuaugaagauuuaucugccagaaucuauugcacuugauaccauagcacauuaaaaaaaaaauucaacugcuguuugguagaagucaacagagaaaugguuucccaaaccaggacuucuucuuagcauguuuggguccuuccuggcuuugaauugcaauaguuuguagacuacauugcuuuguagcuagagagcagaaauaggugggggcacaauagguaagggauacacucacucucuuaaaucuaaacacugcccagguggcaacucugagguuacuucaucucucuacaccucgaugguuucaucuaaaauauuauagaaaaggaccaacuuggggcugggaaauagcucagucuguuaggugcuugccuuacaggaaugaggagcugaguuugauucccagaucucacuguuuaaaagcuagggacaguaguacaugcuuguauuuccccuacugcaaaaauagagacagacagacagaccucugggccucacuggccaaccuuccuaaucuaaucuaggaauuccauccugaugagagauccccagagcuccacaugcccucugugagaagcauguuaucacaccuauauacgcuuauacacauacacaauacacacacacacacacacagcuuuaugugggaguugcuguggagaguagauauuuguuugguaagaguauacaaauaucacucacuagaaucacuagacaagaaaauagggggacgauaaaauauaauguugucuuaguacaaauuggaaauuuguacuaagagaaauuguguggaggaaaacagaaaaagaaagagagccugucacagaguuauuuaaacugcacuggaaauugccccagugcauaacaaugaaauaacaauuccccuccaaagugugauuuuuuuucaagaccauuaaaaaagaaaaauagcaggaaauuuuugauuaucggaaugauaagaucugaaaauaaagacuacaauuaacaucaacacagaauuguuacuucccuaaaguauaaucauuguaaguuacguugucaucaucaucauaaagaagauaccaggacaucccaucagcaaacgguaagaaagaaucgagccucugcacccacaucaucccgaugcauuuguguauacauacgugcacauccauucaggaacgcauacucacuguucuccuuucacaggacaucacugacuaguaagaucugggaugcccucuagcaucaucuccacagguauauaagacuagcagcuaaaugcuaagacaauacaaucaacugcagacacagguugcaaauuccuauccgauucacuacuucugucugcaaugauccagaguaccagaggagacccaggguggguuucugguaguaccagagguaacaucgggguuuucagagucaccagucuaagauggggcugaagguggguagaguaucuaugagggaggcaaaauucucuggagagacaauacaguaugacccaggaagucucuuagcccuguggguuucccauggaccauggcuccaucuguggcugugucauuuuuuuccuuggagccagccuacaggacaucuguauucaccauugccucuaccuuagaugauuuugagguccucucuuuagcugauuaaggggucuucccuuacuucucgguugaaccauccuuggaguugccuccucucuccacaaaacaugacuucauagcacuauacaccuaucuuguuccagcgcacacaacagcuucaagugcauaccuccagaauccuuuaauggaagagccucaccuacaggauuggaaguuacacacucuagcagggcaaggaucccagcuuucuaacagccaagccaccccagaaccuacuuaaauccugcuaccguauuggggaguggggggagaguauaaucaaagaacagaauugaugcugucaacaggacuguagagccccuuggauuggagagaacuuuuggcauguuguugcuaugaccacuacugcaacaagaagccaugaugguaacagugggcggggugccaagcuacuccaucuugcucaguucuccuaauaacaccguagggguggggagugccaguaccagggagacuugguagcugagaaacugugcagagagagaaaggggggaagggaaaggaagcauggaggggagaaaagaaaaauuuaaguaacacacccaaggccacccagcuagcaugacaaagccagaauuuucacuagccauugacuacuaaauucuagccuggaaccucgauaauuuauagcucuccaccacgcucucuuuuucccccccuggaauuaaagacugacucaucuaccgacauuccauuuggguaaauaaagccauuggcacucuacgguaagggaagccaagagguuaaucagcagacuguguuugccauaaaagggaaauguugauuaucagcaggaaaaaaaaaaaggaaucaauauggcuucaaacuguuguaaauuaaaaacagaucacagccucccuacaaaaauaugacugcguuucagcauaaagucauuuaaaaauaacuacuuccagacgccacgcagguuacgcaccggcuucacaugauugguaugaguuuuuuuuaaaaaguuguuaucagaaauacaagguugacaaaaaaaaaucauuuuagaccaaaaccgcaggaaauuuucgaagguuaagaaaaaauaauaauaacuuaaucaaaaaaacaaauguugaaggaaaaacaaaugggguucaggaccaaacugcagaggaaguucucaauuccagcacacaggggaaaucaagagcccaagaacgcgugcaagaaauggggauuggcuuauuuuguaaacuaaagucagaaaccagguggaugccaaaaccaguauuguuuccguagacuggcauguuguggacucugccggcucuguucaccaaauaugugccaaccuuugaaagagacucagguucuguguucaacaccaucauugaacuacguggagauuaagugugaauaaacaguuugggagccugacuuagacguaggaaagaagaagaaugagcugugggcagagagaagacccugugaguucgcuggcaccuauaaggggggaaauguguucacaagaagagcugagagccuuccguuuccaacuguucuaagggcaagcucuaagcggacuucaggcuucccuugugugcggugcuaauaaauuaacauggcaagcccuccucugugauuuccucauugccagcuuccagaagaucccccccagagaaagauuaauaacauuuuaagaacaauacuccuuucuugauggguuuguagcgauuagauauguagacacuguuaucuuuugaacucuauagcauaccaauggugcucugcccugagagugggggauggcugucuguuguauagugcagcaccuuuaagaauuaaaucagcaaauacugauguuuaagguagaaaugucugcaaauugacagacauggguuauucaaaucuugaagaaaaaaaaaauucaagccaguuacucacccuaaucaugagaugacagcacacgauacucagacguaugccugucuggucuaaagaccuccaacugucuaaccuaaacccugcugagccaucuguggugguagacgucuguaaucucugcacuagagaaguggaugcagcagaauuaaggaagucaaagucaaaugcauaguaagcucaaggucaaacugucccccaugagaccucaccaucccuccuguacacauucagauguacuuuuguuuucaaucuugccagcucuuaggauuugaaccaggaagaaguuuugaggguagcaggaaucccaggaguacacacuccagggagucuaagaaccuccagaaggugggaaccaagacugagccagcgugaaaagucagaagauccaauggcugggagcagccugcucgcuuggcaccugggaggaggcacuggcuuugauaacagccuucuggggacaaugaucugggugacaguuccagagccuguauccccacaggucuuuguuguaagggcuguugggauaccacagacguuuaaccuguacccaguggagaccaugcucggcccauacggcauccaggaucucccuggaaauggaagccaucgugcccugguuuaaaggucccagacguuaagaagagaaaguuaauugaguacaaagcaauaacguaugcauggcucucugcucucagcuguggacgugaugugaccgguugcuucaagcucuugccacugugauucccugaugugauggguuugagugggaacuguaagucaaaauaaguccuugcuucucugagcugguuuuucuuuguuguuguuuguuuguuuguuaguuuguuuuugucuugggacacucugucaccauggcagaaauuaaaccaggaugcuugcuuaaucccaaucaccacucauuucaaccagaagauggagaagaaaauacuacccccaugaaauaccaucuggaaauacaguagaacaaacaauucucagguaucaggcagugugucuggguuuuagcaagcauucaacacacacuuguauucaaguggccaauggugcauugaacaacaaaagcaauaauaaccacuacaacuacaacugagugucccucacuaauuguccccugucauuccauacagauuugcucucugcagucuagaagucuauauggaucuaccugaaauaccagagcaacuugucucaacaccccgccagggaccucucuuuaaaauaagcaaaaacauuucuagggcagagaaguacauggggugagacuaguuaguaugacccgaugcucacaaccauaucucccaaaugguuaagauuaaagacuggaaucucaggcccugcauacaugacauucuauccccugaaccagggagcaucuuggaugccaccaggucuaaagcagugguucuccuucuucaggcugagacucuuuaauauagauccuuguguguugugguggcccccaaccauaaaauuauuuucacugcuccuucauaacuguacuuuugcuacugguauggaaugugauguagauaucugauaugcaggauaucugauaugugaccccuguacaaagcucauuaaccccccuccaauagucuagacacagaggucaggaaguacugcuuuaagucuuagucaccaugguguucugcccuuguuuuccuaguggaaauuacaccucugggauagugagauuugugcaugcauuuggcuggguagggcuguccacagggcuggcaaagcauugcugcugggugauugacagaguguuucuggagggauuagcauguggggcaguagacagaguaaagaagacccauccugagcucugugaguagguaccaugugauccacagugggccuaggcagaagaaagagguagaggagggaggugauuucuucuuccuggagcugggacagccaucuuccauccuuagacuucaggguuccagaugcucagaccucucgugucuggggcugacaucagcagcagcccaguuucuuaggccuucaggcuugaucuagaggacaccaccugauuccuuguggauagaucuucaaggucagagugaauugggucagcuuucuugguucuccaaguuugcuguguaacacuggaggaauacucagcuuccauaauuauacaacccagcccccaucauaagcuaucaccuaucuacuucucuaucuauccaucuaucuaucuaucucuuaucucuguauaucaccuaccaucuaucuaucucuuuuuuuuccauuuuuuauuagguauuuagcucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccaucuaucuaucucuuaucucuguauaucaccuaccaucuaucuacuuauccauccauuaacuuaucuauuaucuuccuuuuuuccauuguuuauuuacuaacacauauuaucuaucuaucuaccuaucuacccaucuuucuaucaucuuuuauuaucuauuuacuaucuaucaccucucuguaaucuaucaccuaucaucuacuacuuaucuacccaucuuucaucuaucuuuuuauuauuuauuuacuguccaucacuuaccucucaucuaucuaucuaucuaccuaccuaucuaucaaucuaucaaucaaucaaucaaucaaucaaucgucuaucuaccuaccuaccuauuaugauaaacguugacauucuacuugauuagauugauauguaccuagaagaccaguaaaucuuucuccugagcgugucuauaagagagaaugaccuccccugaguguaacaccauuuauguccaauuaaaugagauagaaaaaaagggaagaaccuacagugaugacauuaucugucuccuugucucuuuccuuuuguuuucgugugugugugugugugugugacuaccuaccaccccaccuucaccuucuggcauaaccccuuucaugacauguuucacuacugugguguuuugcugaaacacacaaaaaaaccaagcggccaccaacuuaaaccucugaaauuugagccaagauaaauaugucauccuuuaagacguuuacaccauguauuuggucacagcaacauucuauccaucucucucuacuuaucugccugauauguugcuccuguuugucuggagauuccugacagacauacucugucucccucugcaacccuugugaagacacaggacuagaaagacuuuagcuauguguauuggcuaguuuugugucaacuugacacagcuggaguuaccacagagaaaggagcuucaguugaggaaaugccuccaugagauccaacuguaaggcauuuucucaauuacugaucaagggggaaaggccccuugugggugggaccaucucugggcugguagucuuggguuuuauaagagagcaggcugaguaagccaguagaggcaagccaguaaagaacgucccuccauggccucugcaucagcuccugcucccugaccuguuugaguuccaguccugacuuccuuuggugaugaacagcagcauggaaguguaagccaaauaaaccuuuccuuccccaacuugcuucuuggucaugauguuugugcaggaauagaaaccuuaacuaagacacuauguaaugagguuuucaggguguuuagugucaaaaucucaccaccugcucccuacccugcccccauuuuguacucaaccccucuuccucugauccaucugguccucccuauaccaauaucccggcaguccugugcacucugcacagauagucuaacccaaaucugaaugugaccugggccacuagagauugggcggaugggaggcagagaccugagcccacuuuccagugagggcugaagccuggugggauuaaaacucuaagagcaaacuucaaggucuagaucacagcaugacacagauaacuuuaaaaaucaacuuucuaugggagacuguuuauauagguucccuucucacugaauagaauauuugaucaacauggauaaucaaucuaaaggcuaauaauaaauaauccuuuuggaaaacaaacgaggguaugguuagcucccccaaccccagcucgauuuuagcuuucuagucuuuuuuuuuuuuuuuuuuuuuuuuuaguucucuguaguuuuaugagaugccuugagaccacaaacucuagcuguaaugauguccugucuguugguuuuucugucaacucaccacaagcuagagucaucucagaagaagauuaauuaaggaaacucccgcucuuggauuggccugaaugcaaguguugggggcauuuucuugauuaaugacuacugugggaggguccagcucauuguggaugugagacucccagacagguggguucugagcugcaugagaaaaggccaagcaagcagugggaaacaagccaguaagcaucacucauccgugcucucugcuucaguucccaccuccagaugccugagccgucuuccuuucaugauagacugugaucuggacauguaagcugaaauauucccuuggcgccccaaguugcuaaugucacgguggguuugauugaagugacagagcacuaacuaagacaagugggaugccaugacaucguuacgucggcagccugguuccucgugagaaauaccccacaacauagaugccaagcaaacacacaugaagugaauccuggggcaacaaucacgugguauguuauaauaaugaucaccaucacaaugaucccaaguuauuacgaaaagcaacuuuuauaugagcggcuuauuaugugccagauaugguuuaaauuuucaauacaccacgauucaguuccauagucacuguaacugugaaacagaccauaauacugcuagccucaucguuaagucaaguaauaccugaagaaaucagccuaggggcauaaagaucaucgugggaagaauacagucuuauaauuaagagggucuuaacaggacuggagggguggcucugcaguuaagaacaacuacgcucuugcaaagguugaguuuuaucuuccagcaccuaauauggaucucacaccugcuuaaaacuccaguucccggagaaccgcucuccucuucugaccucugugggaucuguacacauacaaugcacauauaucucugcuagcaaacacacacauaaaacaaaauacaaacacacauauaauuuuuuuaaaaaaucuaaaaaaaaaaaaaaaaggguauuggcaccguuaggagguagauugauaaaucuaaguaaaaagauacuuuguaaacccccaagguaguuacuguuauuaauaacaaccagcauuuaagcagccaugauuugagcgaccucauugaacauguauguuuaguuaugauuuguauugaggguuaaacgaauuuucuugggguuggguaguggcucaaugguuaaaguauuuggcccuuaagcccugaagcagaaggcugaggaucuucagagaaauauugguuaguacuggaugucagugagagaccuugccuccgugaauaagguagaagaguguugaagaacgauuccuaacaucaaucuuggguugccagauggaugugggcguaaaugugugugcaugugcucacacacacacauggucaccuacauaaaugugcccccuccaaauguuuauacacaugucuccuccaaacauauauacacagagauaaacacacaccuguaacagccacaaaaauggggaaaugccaauauuaaaauucuauaaaguagcagagccagggcuuaaauaaggcugccagucugcuuccaagccauguggugacacugaugcagggugaugaggcugggaaagggagauauaaggcuuaggggauaucuggguccuuuuuuuuuggaccacagcccacuagcaugugagucagagccucugaaacacauccagcuagccugcaugucucagccagugccuuuucuauuaaugggacccgagucaucccuuccuuuauuuaacauacgugggcccuugcauaaaucagagcuacugagaaaaaucaggugcuguacauaccgucuaggggagaggcugagaauagccagaggauuccauaaccaagugcgagauaaguccuuuaggaggaaguaugcugugaaaggacauacagagggacuggaagggcuggagggauggcucaucagugaagagcaccugcuauauccuuuagaggacccgaguuugguucccagaacucguauccagcuguucacaaacgaccugugacucuagagcaucugguggccucuucagacaugcauguccuagguucuccccuccccucucccuccccuaccacaccgugugugugugugugugugugugugugugugugugucugugugucugugugucugugugucugugugugucugugugugcgcgcucgugcgccuuaugcacacaccugcacauaaaugauuuuuuuuuaaaaaaguaaaacaaagguacuugaauggauuuaaguuuaaggaccaggaucuauggaaaaagaaaauuucuuaaaugaguaaguagccuuacaaccaaggucugagggauaacuggcauuguauuuggauuguacuuucuuuaggguauuguguggcuucugaaaauucucuagacacugggucuugcuuuuuuuuucugauauaaaguccuaccuaguucauuuggcaucagacucauuaggcagcugaggcugagaccugccucuaccuuccgagugcugggaucacaagaguucuucagaggccugguuuucuguggugcugggaaggagcccaaggcuacaugcaaaccagcaaucacuuggccaaccagaucacauucauaaacccagauacuggugacuuauaauccaaagcuuuagcuuuuaaagaugaauuugucucccaagaagaagaaagggaagagaaaaugggagugaaugaaucgagaguuugaauugacuucugcauuccuaauaaagcaauucuuuuuaaaaaauuauuuauuuaaugugaguacacuguugcugucuucagacacaccagaagagggcaccugaucccauuacagaugguugugagccaccauguggaugcugggaaucgaacucagaaccucuggaagagcaguagugcucuuaacugcugagccaucucuccagcccaggcgauaaagcaauuguuaaacuccgagugacaacaaaugccugugacugaggaaaaaaaaaaaaguuauccugggggguaacuucuuggggccaggaaaaaaaauggguuuagggagaaguguauuuugagugugauucucaauuauauaacauucucuuaucacaugagcccagggcucuuuugcuacaaguuaauaaguaacuaaugacaggcauauaauucuaaagaaagaugaaauaaaauagaaaacucacuguuguaaauuguguggcucaauacuguuucaaacacagcacggaggagcuggagggaagcucaucaggguaagagcacuugcugcugucucagaggacccacguucuguucccagcauucauggugaaugguuacaacuguauuuaggucuagcucccucuucugacuucaccaggcaucugcauucacaugguacacacacagacacacucucaugcaugcauacacacauauacacacacacacacucaugcaugcaugcacacacacauacacacagacauacacagacacacucauacauauacacacucauacacacacacaaacacacucauacacacacacacagagacacacucaugcauauacccacacucauacacacacacacacacacacacacucaugcaugcacacacacagacacacacacacacacuaauaaaaccuuuaaaaaauauaucaagucuauggugauuauggaguuaguaaaguaagguugaagucuuugauuuguuuuccuauuuaugucauaauagaacuucauauucuccaaagaccaacugaagccauccuaucuaccugccuggaagcauuucccccacaacauuucacaucagugcgaaggaucugugucagccucuccuguaggaguuaccuguccggugugggagacagccacaggaggccuuaccucacuucugaaguggcagggaagacauuagcuuggauaagaaaaagguguuugaauggugucuucaugggaguagaccagaggcuggggguugcuggggagggggggggcucacuggggguugcugcuuuagcacugcuguuaauuguauuagccgcugguaaggaaaaaaaaucaaagugauuuugggcagauuaggcucuaagagugacacucaaaugcagacaaagagcagguuugucuagcagcagcgcuugcuuggccaccccccaugugagacuccgagagcaaauccggacuucucagaggcauguugacagcuaaggggauucaaauucauguccagacaagaagcucguggucaaaugcauccaaaaacucugcagccccgaaugaagacagaaaagaaaaaguaaaaaaagaaaaucaaacagaaacaaugggauuccugucaaugucuccaguaccucccccaguacucuuggcagcauggcucacacuaagccaggggccaauauugcacugacuuucagaguacggcagaccugcuccagggcucuaagugcacauuuagaguucaggcaggcuucaguuccauuuagugcugaauaaaggcagcauaggaaaugacucuuccagcuguguucccaggcacaccauuuucauaaauaagagaagugugccgaucaaagucacaccucugcuucacuccaugagagagggugaacgcuuuaccucgugggguaguuugccaggacuucugggccacaaaaccacagacuuggguggcacaagagacagaaguguuuucuuucaguuucagggcccacauagucaaacucaagguaacuggccauccaguugguucuuuucuugcuaggcuggccaccuucucacuguguccacacaugauggaggaagguguccccauaucucucuuaaagggcaccaguucccucagauuagggacccuucuuacacccuaauuuaaccucuguugccucuuucucuauugucccuuccuccuagaagagcccauuugaggaugcagagaacaugggcguuugggcugcuauauguccuugcuucuuucuuacuucaauaaaagcaguagugauaagagaauagccauacaggugcuauaagaguuaaauaaguaacaaaggaacuaguauuuaaaaaaaauacuaaaacaggggcuagagagaugccccagcaacuaagaauacuuacugacuuugcagcggacccagguacaauucccaguacugaccugguggcuuacaacugccuggaauuccgauuccaggagaucugaugcccucuucuggcuguuaugggcucugcaugcacauggugcacauacauacaugcaggcaaaauauucuuacacacaaauccaaacaaaucuuuaaaaaucuuaagauguaaacuaagaagaauauuuauucaaaccacuagacguauguggaaggaauuagggcguagaaauaugcccuuucauucccuuacuagcugacacuauucuuauacaauucuuugucaauuaaaaaaauugucacuacauguuguucugguuagcuuuugcugucaacuuggcacagccuagagagguaucugaaagggaagucucaacugagauauggugcucuccccacccccucacgucccccaucagacuggccugugggcaagucuaugagugauugucuugauugugaauugauguaggugggagaggcccagcaauaccauucccugagcacgugggccugggauguauaagaaagcuagcagaacccaagccugugcgugaugcaccaaacacccuuguuccauguuugccuuucuguugcuggacugaaggcaguucagggaagaaagguauuuauuugccuucaaggccacauccaucacugaggggaaucagggcaccaacacaagaggcaagacccauggaaaaaccugcuucuaagcuggcucgcaugcucaguagcagaaaggaaacuauaaaaccugcaaaaaaccaauugcuuauuacuccucuuuaucaauaccaauauggcaacuucggcccuugcagugcacaaaauguggguccuugcagugccagauaugaaauguaggugcaguguaaaucuauguuggcuguaccucucccaaaucuuacuuuucucucuuccccaugguaucaccaaugauuucacagaaaauaaguacauauauugggacuguucuuauuccacccuauucuuugaacagaaaauaacuggguaagcauuauauaaaaaacaaucccucccaacuacauggggaacauaugaaauagcuuucaaggcaucagugacuaaagaaggucccacaaaaugagaaacagaaggaaucgauauggacauucuacaugauguucucccuaaggcacucagugaugacaacugaaaggcucgggguaaaauaaguauagagaggaagauuaccaagcacuauuuucugcugagucaagaaaacaauuuacugcuaacucaagaaacaaggaaacuugugccuuguguuugagguuacuaaaauucccaagaccugacgauccaacauccuacaaagaagagaagaacaaacaauugugcccaacaaucauggaggcucagcuuuggggaauuuccuucauaaagcauggugguucagggagcuagaacuagcaacccaaagugugagaaaacaaacccauagcguuggcagucuaauaagggaauaaaacaaagagugaacucuagacauaaaggcagaggagggggaagagauaugacuaggcacauaugaagacuccuauacauggaaaugaggcaagagaaccccaaaacaccaaggccagcuggggcuacauacuaaguuccauaauaaaagacuuaaagccgggcgugguggcgcacgccuuuaaucccugcacucgggaggcagaggcauguggauuucugaguucgaggccagccuggucuacaaagugaguuccaggacagccagggcuauacagagaaacccugucucaaaaaaccaaaccaaaaauaaauaaauaaauaaauaaauaaauaaauaaauaaauaaaagacuuaaauuuugaagcacuaaaaacagguaucaucucaccgcuguuaaauuaaacuagaaauagaaaacaaaaaaaaaauauaugacuggauauuugauauccccagaugucugaaaauaaagcgaucccuucuaacuaaccugcaaguugaaagggaaaagccaaaggcaaaccaugaaauauuuccuauggcaacggaguugacagguuaagauguguagcaugcuucuaaagcaugcguuagaaaagaagaacgggcugaaacaaaggcacaaucuuagaaucuuuuuguucucaaagagaaaggaaugugcaauuaaacacaaggaagggcagaaggaaagcccugcgucuuccagaucauuccaggaagacagcaaaaccucagugcccaagccuacuaaggguguagcaagagaagaaggaugucaagaaacacuucucaaaaggacauaugggaaagccuaugcagacauuuacaaaucagauccagaacugaccaaacgggacagcagaucuugacuauguaagaucuaccccguagaugcgaggguagcuugaugugcacuuaaagaacaaaaggugggauuauccuauggugauaauauaugcugaaacacaaacagauaaaaaaaaaccuguuaaaacaaaacaaaacaaaaagcaauugcuaccaaguagcuggagagagggcucagcggcuaagagcacacacugcucuuacagagagagaacccuaggucuggguccugccaccaacaucaggaggcucacaacugacacccucuucuggccucaugugucuauacccauaugcacacaauuaaaugugaagauugaaaucuuuuaaaauuacuaacaaaaggugacaucaaucaaguugaaaggaaucugccagagcucucagagacuaaaccacuaaccgaagaagaaacauggagggacccauggcuccagcugcauauguagcagagaauggucuuaccuggcaucagugggaggggagggcccugguccugugaaggcucaaugccccagcauaggggaaugccaggacaguugaguggaagugagugggugaaugggggagcauccucauggaggcagggagagaagggugagaugggggggggcggguuuuagaggggaaaccaggaaaggggaugacauuugaaguauaaauaaacaaaauaaccaauggaaaaauauauauguauauauauauuuaucuauaucuaucuaucuaucuaucuaucuaucuauauauauauauauauauagagagagagagagagagagggagggagggagaggagaggagaggagaggagaggagaggagaggagaggagaggagaggagaggagaggagaggagaggagaggagaggagaggagaggagaggagaggagagaucauucaaaaaagaaaggaaucagucuuuaaaaaaucuggacccugagcaauaaaaucccuaacuaauaugggugggaaucacccaaugaauggaaauccugaggagagaaaaagaggugaaggcagggaaacuuugcucucacugaagcugagcccacaaucuucuacugucccuggguacuguggacacaucggcaucucaggccuuaccggccugggcucaaaacuccuucaugggcuuuccucaugccccagcuuacggaugaccacucauagcacaucuggcucgauacggacaggagccaacuccgcauggcacguaucuuucuguauuucuguuucucugaaaagcccaaacaccucaggggugaggcacugauaggcagaugagcgcauggcagcaccaugggcaaccuaaaauuggauagcauucauugguugcuccuccucugccuccuggcgcauuuggcucccugaauucugaggacagcuuacaagauccuacuaguaguuuugcucacagauaaggaaacaaagacacagcaagaacaagaaaccggacugucccuuguacccccuucccacaaaauucauagcuagcuaagagugaugucagcagcaacacauaaguagaauagaauuggaggagguucaugagacucgggagguaaaugaaauagucugugucugaaaguggagucauggaagauucuagaaggcuccuccaaagcuuuacugauggaguaaacaacugugggggaggacacucugaccagcuuagcugcagagacaagauccuggggccugccagcuggguggaggcuuggggcuccagcuuucccgagucuucauguauuugggugggauuuccuaugaugcagcugcuuuugaguuauuccuguaaguaacgcuuuuccuuacuccuguuaguaaccauagcaaaaaucggcuggcucccgaagcauuguucuccaaaugccaauucuagguagacaaauugugaagguagguaugauuucuagaauuuuacauuagaaaguauuuuaauggcccuugauacagaaaguuuuacuauaagaugccagaaagugaugaauugggagauauuaaaauaacauuaucaaaagaaaacauucaagucgggccugauggugcauaccuuugacccuagaacucaggaggcagaggcagguagaucucugugagucugaggccagccuggucuacacuauguauguucuaggccagucaagacuacauaacagaaacauucagguggccgagagauaugccaguaaauagagcauauuuaucaacaaauaucucauguccagguaaucaauuagaaaaaaaaaaggcaaacaaauucaaguuuuugacaagaggcucuccagaggucucauagacaugugagaacuauguagcuuccaagaaaaacacaggcaugugacacaacaugcucaugccacaugagucaagauaaaaauagaugguaauacaucauguacuggcuaugaacugaaagcaaaauguguugguuugaaugaaaauggcccccauaggcucauagggaguggcacuauuuggaaggauuaggacauguggccuuaaugaagaaggugugucacuggggguaggcugugggguuucaaauguucaagccaugcccagucuccccucucuccuguccucucuccuccccucuucucucuccccucuucucucucucucucucucucucucucucucucucucucucucucucucucucucacucucucuccaggcagaacuccuucuccaucaccacguuugccugcaugccacugugcuuccugcugugaugauaauggauugaauuccucaaacuauaagccaguuccaauuagaccuuuuccuguauaaggguugcuuuggucaugguguacauaguguguauucacagcaauauaacauugauuauaacacaaagaaaacucauacagagcuggagauguauaugcauauaaacacacacacacacacacacacacacagagagagagagagagagagagagagagagagagagagagagagagagaggcgggagaacaauuguaaaggaacuuggcauuuucuguaagagcuggaacuccauacauacuauaagccaaaaauuccaccucaaaacacaucuaacccaaaauagacuauucaccagaguguuaccuguaaucaccccaagucagaggcugccuacucuucaucaacaagggaaugggaaguaaauacuauuauuauuaaaugggaugcuuuagacaaaugggagcaagugagcaagaguuuuacuauuauggcuggaugauacaaacauauuacccagaaaaagagaaaaggagagaggaucaaacagcagccuccuauugguucuguguauagcagguucagagacagguaaaccugaugcccagaggcaagaaucuauugaggcugucauugagagagaaaguagagaggagcucuaagaaaaguucucaaggcuaucuauagucucaucuggcuugucacagaagcauggccauuuuguaaaugaucaacccaagagugacaccuuccccaauagauagcauuucaaucccucauuucuauucccuuuaaagcagaaaccgaaggcuuccuuacgaggagcaagguggcaugcgggaccucaggagcaccucauaaacugagugggaccuuuagucagaaaaagcuaagacugagagugcaucgccugaagccuguucaacagaagcagacagucauaaaaauagagauaagaagcugcauuagacaaacauagcauuuaauggggguugggaucuggggguggggggacuuagcuuauucugcacagccacaaaaaaacuauucuaagccgauaggacaggacaaacaggaucucagacacucugcgcucaguagcugacucaacacccagcgcugacagauuuacaauggggagccgaauccucagauagaaagccaugugcucuuuuucgggcuuuguugaccuacaguauacccucgaaacccuuaaaucaacagcuccgaagcguuuauggugaugccuucugagaagucugcuuuauacaacaagccucgucuugaguccgagcucagcuaaaagcugggcuaucacggccgggccuuugcuaacacgggaaugaaaagugcccuacuucugugaaaauaauggaacucucucucucuuaugccucaggcucugaggggagaaaaaaaaacagacacauauagagaguagagaaguuuguaaucauuaagacccauuaaugccagggcagauuuauuuacccagugacucugugucucuuauuguucuuaccacaaagguuugggauuuuucagguuccauuuaaguggcagacauaccacuacuuuuuaaguauauaugugugugugugugugugugugugugugugugugucuguguacauguaugcagguaccuaugaagucuagaaagggucaucuuugaucccuuggaguugaguacaggucauuguaagccaccuuaccuagaugguaggagccuaauucucaucuucuucaaggacaguccaguugcuuaacugcugagcucucucuccagcccaccaaugcuauuuccugauauacaaagaauacuuuguauauccauuaaauguggaugcuugaugauaauguuuuuuuuuccccaaacaucuuagcuaaaagccagggcuugcaaacucaacacugucauauuuuauaacauagcuccauggaagcauacccguguguacuguaaacucuguguuguauucuuccucucuagcaucagaugauuaguuauugucuagcuggcucuauuuugcuugaguauauuaugugugcagguaggcauagaagauguccaugugggugucuuccucgguuacuuuccaccuuaccuuuugagacagucucucucacugaacuuggagcucacuugaugaggcuagacuagcugaccaaugaguuccagggacuguccugccucagccuccucagggcuggggucaugccaucuugucuagcuuuugauucagugugguucugagagacugugcuggcuaguuugcagccaacuugacgcacgcuagaguuacuggggaggggagaaccucaauuaagaaaaugccucccuaagacugggcugugggcaagccugaaggguauuuuuuuauuuagugagugaugggggagggcucagcuaucccuggacuggugguccuggguucuauaaggaagcaggcugagcaagucaugaugagaaagccaguaagcagcaccccuccaugacuucugcauuagcuccugccucuaggaacugugucugaauagauuuaaaacaguaucugguuuuguuuguuuguucauuugcuuuuuuguuuuguuuuguuuguuguuguuguucuuuugagaaaggauuucuuuguguacccccgacuguccugaaacaugcucuguaguccagacuggccuuaagcucguagacaucuaccugccucuccucucaagugcugggauuaaagguguguacucugccucugcccagcucagaaauaugaauuuuuaacaggcauuuacauaauugcuuauauggguacacugcagugaucacuuugaaaaauguaucagagggcuagagagaugucucagugguuaagagcacugccuguucucccagaagacccagguucaauugccagcauauacaacagcaacuucuauaacuaucuguaacccaaguuccaggguuuuuuaauacccucuuccgaccucucugaacaccaggcacucacaugauauacacagugcacagacuuacagacagacaaaacacuuauccauguacaguaaaaacaaaacgaaaaauucuuaaaaacagagaauauacuggccauccauuaauugccagguggggaaacugagguacggggaugugaagccguuugugacaagaaacauggccuuuaggaagcacaaggaaugaaguucuagucuucaggcucauugcugcacuaccuugccaagucucuaagggccuuuuccucuuauuugagccccuguugaggaagggaugcuacccaaacaauagagccaagcgagagaaaggagaacaagcccaucaagagcacugaggacuucuccucagcaacaagucggguccagacccaggacugagcucagaguugagcacaccugcuuccuucagccugcaugccaaccaaacauagccagcacauguuuucaaaaccuuugcuugguucacccaaccuuauggugcaugcagcaggcaacagaacagacagcauccucagaggcaccccaucuagcagcucuacaagcaggcaguguccuguggggcucaaguacacccauuucaauccaguucagcuauucaccaauggguccucauuuaccugccaacagagcacaaggaaggcacuggcugcuuguccuggucgauggacuagagauugaacugcagcaauucuguguuggugguagguacucagugaauccuugaagcuuugggcuccuagguuacauccaucauuuccacucccugccucucaucacuucuucaucugaaccacagcaccggcuuuccagcaucugcauaccaucacuacucgagcgucuauucacuagugaugcugauguucuucauuaagaccauccgccgcuacugcuccccgaaugcuuccgaggauggaguaguugaugauacacaacauacauuaacgaauagguaauuuuacauccgacagauugagcuacggauacuguugucguuaguuuuuuugucaguuugacaaagccuaccaucaccugagaagaagggaugucaguucaggaacugccaccaucagauuggcccguggcaugucuaugggggcauuucauugauuaauggcagcugugggaaggaccagcccacuagugcgaucacugagcagguggguaguuguguagggguuguguaagagagcuuagcugagugagacauugagaacaagccaaucaaccaugcuccuccauggucucugauucaguuccugccuugagauucugccuuggcuucaucccucaaugguggucuacaaauuguauuauaaaauucacaaauugaaucuauaaagaagagaagguaagcaaagcugacuuagccaaccaccccugggauggcuuauguaucuacaucauggugcuacagaguccccagauacuuaaaugguuaauucuaagggugucuuugaagguguuucuaggugaaauuaacaguaacuuuauagcacagaugacauagauggccauauccagugugggugaucccaauacaaaccacugaaggccuagauagaacaaaaaggcugcgugaauuggaagucacuguaucugcugccuuugagcuggcacaucuguuuuucccagucuucugagucagaguggaacccaacacauuggcuuuuuccuggacccacaucuaaccaacaacagaucuugagacuucuccguuuccaaaaugaaugagcuaauuccuuauaaugaaucucuuuaugcacacaugaauauaaagagcaguaaaagcuuaguuucucugggcagucuuauuuaauacaggccuguucaugcucaaccuauagcaagacuagaggcagcacaagagaaaaucacccccuguuaucugccugggcugggagucuuuggaucagaaguaaugucaccuguucuauacuuaaaggcagguucuauucuacuuucugaguugaaggaguuacggacucaacagguagauauaacauuagagguuaagaaucucaaacacuugagaaaaggcacuugcaaggggcacuugagaccagaacacggaaccuuccaacggauagccuuugaccuaccugcuuugguugucagucuacacaagcaggaaaucugcgcaaauauucacuggaguagaaacagaagauagcuaaaauuugugguacagucaguaugauaguaacucagacucaauagguuguaugaauguaaaaugucuccagaagcuccuagguuugaaccuuugguccuccuggcaguagcacuguuuggaaaguggugggaccuuugggaaauggagaaucgcuggaagaagcaggccauuggaagaagcaggucacuggagaaugugagauccucuuugguguuuacucucugcuuccagacuguggauguuaauuugacugggcacuuugagcuucucuuccccaaaauuccucugcuaugcuuucucuaccaugaucuacuguagccccuccaacuguaaaaccuagacagaccauuuuuggaugauugguagggaggaagaaggggauccguaggaauaggggaaggguacaaaaaaaaaaagguauaggacauaugauaagccaaguguggugguguacaccuucaaucccaggacucgggagacagaaucauguggcucucuggugaguuuaaggagaucuuacucuacauagugagauucaagaaaggcagggcuauauagagagaccaacuucuaugcaaaaggaaaaaaagggagggauaaucaaaaauacacuaugcauauguauacagaugaugcaaugaaugaacgcuauuauuaucuauaguuaauauacacuaauaggaaaauaaaagguaaaacuaaauucuuccuuaagugccuucuuguuagguauuucucacaacaaugagaaaacuaaguaacacacuaucuacauuuagcaucccuuuauacuaaauuauuuuugcugugggacuucuauauucacaaagaaaauuuauaaugcucugacaucaguauuuguuuuguuuuguuuuguuuuuacuuuccuaaguagagaucuuuuuuaaaaucaagauuuuugcuuugcucccuaaauauguuauuuaguguaacuaggaaaggaaacaaauguccuuagugaaggaaacaaaucauaaaucuaagaccuaauaaagcgcuuuccaucuggagaaaacaagagcuaaaguuaauuaaacugcaaguuuuaaccaaauauaauuagaagaagaaggucuacacgcaaauccugaaauuuuucuaaacaucgccucuuucauuuaucuucaagggcauccccaagucugacuuucaucaacaggauuggguaauuuucuauguaauugaauaaugaccaacugcuuccaaaacaagaccaucaagccaucccacaguacagcugccgaggcccugaaaauacuuuguggaagagaagcaaucgaacaaaugaauccauaagaggggacucuucgcccccucauuucacugucaauguuaaugaacuucauaaccuggacuuuacaacacaguggccguuucugggcucuuuaguuauagcugcucugaacuuaauguacacgcaauguaggcugcauaccagucuuuaucaacugguguaaacuccaagcaucucauucacaacuuacaaauugauuauaucuugaaaugauucucuuuuucaugguuggggacaaaaaaaaguguaaucacaauauaauuuucauccauuuuuuugaugugucauuuugagagaucugaaaucacauaucuugacuucaagucuucuucaacagagagagaccacacuccuuagaacaaagaauagguacaguucuaugcaaugcaaaaaauaaaauaauaggacacuucauggguucagaaaaaaagaugucuguugucaugauuuaaaaauaaaagacuacuucacacuagaauuagauuuacuaaaguaaacaucuucaaagacacaccugagcugcagaugaaaacugagcaguguaauccacagauaagcauucuugcuuuacaacuuuaccccacaugucaucauccaggcaaauuaaagaaaccaauuaaaagcaguuacagcaugugaagucauccucuaagccaaccauggaguccccaccuccagcagacuguuccuugacugguacaucauacacccacuucuacuuccugcuuuaaaaccacauguaguuacugcggucagguggggugggguauguggugaucacacaucugacaugaaaaguaauggaucaacaagaccgucaguggauccaagguacaaauauugacaaagccgcauacccucauguucugugccauggguguuauaccugauacaacauggcucaacagugugccagucaauucucagugcuuuaaaagcagcucugggcucaaugaacuugaugcccuaugcuugccuagauccucugugaggucacaagcucuuugcagaaaaugcccaaagcccuuucaucucuauuaacggauuggguuuuccauuccaaaaggcuagaaaagaaacuugacccagaguuacaauaaaauaucagcuuauagcucacaacugaaacaaaacaaaacaaaacguagucuaacuaacuucaggcaucaccagacauaaggucugugaccaaccuauuaucagauagcaagauggcugccagaaguuguagguuuacaacuuagguuuccucuuaguuaccucagguggcucguaauuucauuuuaccauuucggaucucaaaccaaucccuacagucaaagauaccugaccuucuggcaggucauuaugggaaccaugucauggaggacggguccuuagggaaagccuugcuuuuaugagaagauugcaaauagggucaacaagauggcucugugagaugggcuugauucccuacaacacguaugguagagggagagaacagacucccgcagguuguacuuagaccuccacaugcauguuguagcauguguccacauguauauacacauguaugaauuaaugugauaauuuuuuaaaaacugcaaacauauaguaccuaagcaaaaauucaacuucugaagcacuauguaaaaagaugcccaacugaccuuuuuuuucccccagugaauaaaugagcuauaucaaauucaugauguacucuagacaugcaaauuacuucuugguuucuaauuauuaggacaauaauuaugugcacauguuuauugggugcauccuauguuucaaugaucacuugacaccuaguaacagcaaugaguagcagagauaaggcuuuuaaggggagcgcacacugugaagacaauguugggaaggacuuucugaggcaacggcauuuacacacugauccaaagagcauuccgauguacaaucacugaagcagaggcucuuggaaugcugaaaggcaguggagacauggcgagccacacuggugagcuacacuggggcacacaaggauggagaagacaggaagguggguggaagaggccagaucacauaggacccuucaacacuaggaaacuccgacucuuuucucaguagaaacaaugaagggaacgugaaauaaugggguuacugcuacaguggagcuaagaugcaaaacugagacuucagguaggaguacugugcugggugcccacagagagacacuuguggcagcaagacuagaaguacuguaauugaucuguaugugaaugaugaaaucuaaauggcagggcuaagauuuccagguucuuuagacuuuccugagcaaaugcaucucuuauacugcuuggucuuuacauuaaauauuagucucauuauuucuuuauuuacauccuacccugucuuccuguaaacaguccuaaacuaugauguugauuuuuuauuacauucaauuuguaauuuuguguguguguguguauguguguguguguguguguacgugccacagagaaaguguggaggucagaagacaauauacaggacuccauuaucaccugcccugggggucauugucaccugcccugggggucauugucaccugcccugggggucauugucaccugcccugggggucauugucaccugcccugggggucacugucaccugcccugggggucacaggcauuaaacucagguccucaggcuuggcuauagaugcccuugucuacuggcccauuucaucugcaauacuuuuuuuuauuauauuuaucuauuuuaaugggauuuuuuacacucuucuguugaguuuaaauucaucauaucaguacucuaccuucaucuuaaaauacuauaaaacuuaggaaugauauaauuuuauaaccuuguaauaccaaacauuaucuaauaucuguuaaauauguaauggcuaggaauacauguuuuggguuauggguggauggauggacggacaaaugggugaauggauggauggguggauggauggaauaaagaaaguacuuagggguggagaaaaaguuaucuauuaacaaccagaaauagaaauaccaaagagucuuugacucuccuuacccggcaugguuauuaagaauauuucacauaggcugagucauguaagcaucacuguaucacccacugccaaggaugggugagacagcuuuuaauuauuaagucaacaggaacauggguucuguggcuucugcauucuaacuaaggcagagcuccaggucccaucaaguaucagauaucucaacagaagcaacagugcaugagucccacuuacacgaacagauggagaguucucauccagcuuccaagggcaucagggaagaacauacucaagggaggagaguauucccgaaucauucccagaacugcucacuguucccuucugauuggucaagagaacaccgaggacacuuaauuucaucuuagaaaaacuacaaacauaggacuagaauccucauuuuuaaccuacagucauauagaguuaggcugaaggcaaugauaacucuuacucuuaacauucugcucuuacgucuaaaagcugcccuguuuucaggagucuggguaauacgugaaacucacaaacuaaaauguuccccagacuuuuucuucugccaaccgauccaccagcaccaacaccccaagacuaucugcacacucucagcagcccccucaucccccuguguuauaccugcagccucagcacguccccugccuuauuuaugcagcaucacuaaaccacccgaucccuacuccccugaacucuccucagcagcuauagcccuaaaaggcagaugugguccuguuucagggacguuuaaagcaggggcaugaugaugcuuggaaaugcaccaaaauucgaagcauuggaguuugggauuuggaggcuagaauugcuuagcuaguaagccuaugcaaauacacugaaauuuuuuuuaaagaaaaaccuauaacaucuaaaacauuucuaguauugaguauuuuagggaagggauucucaaaacugccugaaagcaguaaucucacugaaaucaauagcacgcauauuucaaaaauccaacuugugugaaugguuuucuuuuucuuaaugaagcgauuucaugguaguacuguauuaaaaugugacccaugagagucuaugagacccuuugggcuggcacaauugagggaugcuaacgguguuuaguagguaaaggccuggaaugcuccuaaguacccuaugaagcauagauauuccuuccuaaagaaagcauuggccauccuaacaccaauaacauuccauugagaaucuauacuaacuagagagauagcuuagugguuaagagcaccuacugcucuaccagagguccuaaguucaauucccaacgaccauggcucacaaccaucuguaaugggauccaaugcacucuucuaguguguaucugaagacagcugcaguguacucauauaaauaaaaaauuaauaaaucuuuuuaaaaaagcugggcgugguggcacacgccuuuaaucccagcacuugggaggcagaggcaggcgaauuucugaguuugaggccagccuggucuacagagugaguuccagaacagccagggcuacacagagaaacccugucucaaaaaaaaaaaaaaaaaaaaaaaggaagagagagagagagagagagagagagagagagagacaauaucuauacuaauauaacaauuuccuaagcaauuuaaacaaguaaguauguaaggaaacuggcugcuucucuuuagaggaacaaaaccaauagacagggggagagggaaauagagaauacacaugugauaaauggaccauuugaguggcuuuugguauagagacauuccaacaauggucaucugcuggcuggagaaacagaacugagaacuugcucaaugaagccaagugacuccacaguucugagucugcauugaaagccaggaugaucccuaggaggucacuggugcuguauccaccucagaaggcugaucaagccggaccgacugcuauuaauggagaacgagaaacacaggcagacacacagauuuccuuccagacuuuuuauuucuggaccaucaggggauggugccaaccacuuugauggggguggucccuccuugguggguccuguucuggacguucccauacagcacacccagaggugucacucccaggugaucuuaaaucucaaugggcugacaaucuagaccaaucaucauaccuacuaucucaccugcuacacaggguggguggcagaugguccaagaugaccaugaaccuaacaggggaaggggcuugcuuucugcuugaacaccagaccuagaauaagccucagauacuuguauuuguauuacucugcuguucaaaaaaguuagagcaaauaagcaguuucuaggcuuuugccaacucaaaaaucaagucaaaagugugugacaacauaucauauucuuuuguucuguaaaggaaucuacuucuggucucuuaggacuauaguuagaauccuauuccuuugaagaaaugaaaugaaucucuguuugccugcugagcauccauuugcuugcucuuucacagucaaaggcuacuguaguccuggaaggcugacucucccgacaagugagaaucucuuaccuguuaagcccuucuuucucugagccccagugaugucugcccacacacuagacccagauucauagagcuugcuugauaagguuagaccuuccuagaauguccccagguaaaggccaacugauuuggaagaucucgucccugcagcaucuagauccagugacugaccacauaaccggaagaguuauguauaucagagcccaggaauauaggaggacaucuuggacuuuuacccuuuaauaucauggcuccucuuuuccuuguagccuccacuuuacagacaaguaaaacuauauuggucaguuauucccccccccccagcaccuuccuguaguauuccugcaaauuccuaugagccuaaaauuauuuaaaaucaaaugcuggggcugagggauaagugaacaaggcaugaaggucugaguucagauccccaaaaccaacaucaagucauugcaauagcuugugccuaugaucccuuguauugccagaugggaagaugagacuggagaaucccuggaaaugugagggauagcuagccugguguagucaguaacaaaggacaaggcauccuguuaggggacaaguaaccuggcauagguagcaauaaacagcaagagaugccauuucaagguagaaaaugaggucugacccuugagggagucucucaacccucccucaacaucuuuaacaugaaauaaaaacuuuaaagacauuuaaauguuaccccaaagaaucauucccuuaaaaauugcaucacuagugugugugugaggggugucuaaaauucaggcauuuuaacaugucauucucucauuuuaaaccauuacaccagcuauuucugagguacugaggugucuaaagucugugguauuuacuuaccuauaugaaagacuuucaaacuugacuuuguuuuaggacuacuuggggaaucuugaaaagauggugcuaauuuagaaaaaaaauucuaaaggguguguggaugucuugaugugcggauaacucccaacuuucuguuccuggggucuggacuaggaucuuaauaagaucauccauagacuuucagcugucuauacucaaaaucaccaacuguccuaggcuucuuuuguuacucauuguggcaguguuaagcauguaguguugagcaccaguucguauucaucuuacacacagagagaaagcuuugacaagacaggggauucaucccaugccaaugaguuuuacugcaaagugauggcugcaaacccugacucccuaagaggcugcagagauggacaugucagccguauuuagcuucaaucuuauuuuugacaugcauaaaacagucccuuggacuuacccacaacacaaaggauuugugaucauaucugcucacagagaaaucaaugcugaguuaauccacacggggccuccuggaagcggucaaguaaaacgcacacugcagaugaggggcuguaggcucacagggugaccucaggacaccaaaggcugcucuguuacagagccuggcaaguuggcugacauaaaccucuuucccagcuuaucucugucuuucaagugcugccccucaaaggaggcucuacccauagcuggcuccucauaaaucaaugaugaccacaucuaauuuauaucagaaggcauggcccugugacugauggguaaaaagggcagauuguauauuucaagguugaguggcaugaauaagccaucaaaagaauccuccugaaggcaaaagccuucaauacaucaaagccaucucuucaggagagguugccacucuguccaggcagaacacucaccagaccucuaucagagcauuccuguauauucugcucuauaacugacaaccccccccaaaaaaaaaaccaaaaccaaaagcccccaaaacugugggaacaggcuuuuccugggauguaaccuugauguaacccaaacuccugaguuuguagacagugcuguauaugagcugcaaacaaauauuuuuggucaugaaagccuucauggguaguacuaacauuaggccuguuuauauuuggacuuccaagauuuaaucagcgccauuuucucuugaauuguuuauugcuuauggugggaaaccaugcgauuuuccagcucauauguucugcugacugaagcuccuugaagccacugucuuggguccaugcaaaacuaggaggaagggaguucuuagaagauuugcauauugaauuauuaagguuauaaugacaauggcacuuggcagcacaugccaauaaaaagcuuacaauccccccugcuacagcuaauauccuguaucugauaggucaguguuuucaaaaaggaaagggcuugcugcccuaacccccacuccugugaaauacaguucuguaugcaacugagagacuugaagauacauacuuaacuuuuacagcaacagcaaaaacaaaccagauauaagcauauugaccaaauccuagggauccucucugaagaggagaguagaaagagccagaauaauaaaauugguguuuucugagcacagcagggcggugacacauaugaauccacaguaguugugacaacaugaaccuggccuggagaagcucaagccagacaaaacaucaaggugcaaguggggagguaagcauagacuccaaccucaggcugagacgcucuuagcaacugaggacagcuaagugagcgcgaguugguguucucuuaguaugugauccaugguaggaugaucacacucaaggggauggcccacacccaggagucucugggcagcacaagucggacuggauugcugugugucuuaaagaggacaguaggcugggugagaagggaauggagguggaucaucaaggaauugggggcagggagaugaaaaugaucaaaauuucaaacugaaauaacuccaaagacaggccuuaaaaaaaaaaaaucucuguacuaccaugacaaagauaccucaauacaaaugucagugaauacaaccuccccaccacacauacacacacacacacacacacacacacacacacacacacacacauacuauagagcauauacagguacacguaaauaguccccucuggguuaacucacccaugcacauauaaagaaaaagaagaaggauuuuguguucuuguucugaugagcacagccauccauucaaugaagacucaaagucuuuguaaaggcaaauaaagccacacauaccuguucugagccgugacacaucgguggcucuagggauggguaagucaggugagaggaaugagucaggaagccagugggugccugaaucaccuggagcucaggaggccauguuugcagaaggaagccaagaggaggaaaggauaauggaggaggguagugagugcacagguacaugaucuggacggacccagcuuugcugaaugcuagcguccuagugggagagaaggaaagggggagggagguggaaagagagagaaagggguagaaaagaugggaagaaaggaagaagggaaggagggaggaagagaaagugaguugggaaaaaagaauuggaaauggauggaaaggauacauugaagccauuucagaaagauguacauuuuaauacauaagcauccauauacacgcaugccuauauauguaugucaugugugcauauaguuguucguguguguguguguguuguaguuugaaugagauaucccucauagacuugaguacaugcacacuuagugcccaguccguggcauugguuggguauguuuaggagguguggccuuccuggaggaagcacaucauuggaggcaggcuuugaacuuucaaagccucaagccaugcuuucccaguucacucugaugucugcuugcaguucaagaggcaagcucuuggcuauuuuggcugccacguuggcagccugcugccaugauuuguagucagggugggcucuuaucucucaggaaacauaaauccaaauaaacucuuccuucuauaggugauguugcucauggcauuuuuauuagagcaguagaaaaguaaccaaguacauacacacaauuaaacacacacaucaauuauacauacauauauauaauauauauacacaaacuauauauauauauauauacauauacauauacauacauauauauauauauauauauauauauauauagagagagagagagagagagagagagagagagagagaaugagaucaaauguccugaacacuguagucccaagcuauacaccacuuguucuaauaaucacuuaauaguaauaauauugguguaaacauucauucacaaaggcgcuugcaccuguacuauugaaaggaaacagggcaagcaauuuguguuuuauacuaagugccagccagcauuuaagaucuaaagugauaaaucuuuucucccgcccccccccccccaaagacuuggaaaagucaauacagaggcucaaguccuacuucugacuaaucugccaacucuugguaaaacuuggcugucuguguuuuaauaaagcagacagucucaaaaaacagcuguagugggugcugacugguaacuuucaacuucuguucugaaacuguggugccacgcuagcccuuaagaaagccugggaucuuaacaaaucugauauuuaaguuagggaauuugauccugcagggggcaccaucuugagcaucccuacagggucuuucuugccaccaaagauccaugaggcggcuggugagguccuaucagcuuacaguggaguacaagcucacagugagggagugaugugccuggcugugcaggucgccacgggaagagcuggaucuucagagucugaagacacagaucugaacuguggucugugugcugauccccccaccccccccaucggcuuccuucuuuuauucuuucuuccuugauacaauguuuccuuucccugcaagauuccuaacuuuuacagcaagaggguugccaacaccaaagcgauucuuuuccuguucugacaggccugccuggaaaggcuucaggauuugggggugggguggggugggggaagaguucaauggccauuuccugcccagaccaccuccuaguucaaagucaacaauccagcgggagcagcuacugugugacaaguucagcacuuagcaccgucuuccucacccucugccagcugccauuucuacugaacagaugaaaaaccugaggcuccaggaagcaagcucaggguguccaggaugcccccagcaagggcccuggagucaaguauggcccgcagaauuauccagaaggaauggugcuuaauggcuuuauuaugacaggcaggcaauacagagggaggcugggcccuuccgacucucaugggagacuccucaggcuuaucuuagcuacucuagaguccuacucaaccccccacugccccgcaagagcuuuggucuuuggaaaaaagaauuuuuucuuuuaauuugguuuggccuuuugcucggagcauugauaaaagcaaauaauucuauucacaaaucaugucuuaggagaacacagaggagaaaagccaagaaaauaaaagggucuuuuuacccuugaugaauugaauaauagccuaagaaaaacaucuuugauuugggucagccuguauuuaagaaacaugcaaauacaacccagucuaaucuguaauuucacaugauccucucaagugaccaugaaguuccaaguggguagauguaauucaacaaccccugcuagccagcaaggcccugcaaaacagcagaaacaccggcuaggggcauuuaacuucagcccuuuuaugaauggaaaucggcuuucuaaagauaacuuggcaggcagugacuagcaauaagacaacucggugacagcuuucggaguuauaaaauacuuuugaaaaggaggcaucaaagcuuucagccgcuuauucauauccaagcgcuucaaaagcuccuugcagggaccaagguucuccugagaauggucacuguagcagucccaggcugcaaaggccaccccugaagaaaagacacaugugacaucagggcagcuguccauggagcagacaaaggaaagagaagccaaaggaagcaagcgacaaaguuggauggcgcacaggggauccaggcuggaagagauccuugaggcagccuugguuguuguaaccacucugcuggagccuggaauacaguugggaguggagaccaugagccaacaccagacagaagauucagcaacaaauggcaaagcagccuucccuuguggucagcuagacucugcagagauuaucaaaagucagcagacccguccgugcacuguagagcuagcugaacagacacacgaggucaguguguguguguguguguguguguguguguguguguguguuuucacuuacuagacauguaaagaacagagccuagucuagacugaguucauuaagcaaaagucuauuaucuccaaguagaauaaacacauugccaucagaggucagguacaaagaaaaggcauauuaucuuaggccuagcaauuguucuucugcaauuauauuucagucagaaguacaauuuuaaaucagauauauuggucaggccaguaccgauuucaucauuuagagauucaaaaugcauguuaaguguguuuaaagauauggaauggccagggggcauagcuuacuugauagaauucuuagcucacacaaaguccuggguucaauccuuaguaccacagaaaaccagaugugguggcacaccuccggagauauagacaagaggaccagaacuucaaggucagccucaguuacauaggaagucugggcacaggcacauggcacucacugguucucacacagcagaaauggccugggauguagaucuuuugauagagugccgggcuagcacucacagagucgagcuuaaucgccaacacuacauaaaaccagacagaagugaagcugaagccaucccagcacucaagaacuagaggcaacguuaucagaacuuccaggccuuccucagcuccgugaggcaucugcggauagccugggugccuaccuuucuuuaagccuagugaccaugaagcucuugucccuagaggugauuuucaugcagaacuggacaaaaauuucaguacaaaauugggggaaaggcacaguuuccauggcugucuugucuagaugaaacugcagagggggaaaaaauacccaugacaaaacgcguuggagaaaagucuagauuuaaacagaauuagacaucugucagugauguaggacucucugacucacggacaugcugguacacacugcagggcugaggggugcugucugguaccaccuugcccagccucucccuuuucugaagcuauagcuugugggcucuuuguuccugagcucugaugagccacagcuuagugacgaguuaagaugggaauuucuacaucuaagagccuguugcuguuucuccuccaggugugucuaauccacaguccgggggcuauagguagcugagcagagcuaugaacccuaagcuuaccuuaaaaaaaaaaaaaaaaaaaaaaaagguuguuuugugagugugugugagugugugugugugagugguguguguguguguguguguguguguguguguguguguguguguguguaaaacuggauuacauggcaaagcaugggcuuuguagaugaaugauguccuguuacagauucaaaacauuagacauuagccuggagagauggcuuagcaacaugcgacuguuaagaacugaaauguaaaugaaguaaauaccuaauaaaaauuggaaaaaaaauuggaaaaaaaaaaagaauacuugcuaguauuguagaagacuuugcuuugguuccuaacacccaagugauagcucaugacugccugugacuccuguucuaagagauccaacaggcucuacuggccaacuuggacaccauacucacacagguacuaacucaauacacacaaaauaaaaauaaaucuuguuuuuaauaaaaaggcuagacaugccuaacaggguguguuaauggcgucaguguccuccucguucacaccuuuaccggaugugcucagaaaaguaucugcuaugagagaagcaauaaucccccauuggaugaaggaaccaagguggcuuccccauucauucccaaacaaaaguguucacaguuuacuaguucccaaauacuaaaacacagcaaaauuauucagaaaacauauacaugccugggcccaaauuccaguuuuauggaaagggguccaaauuuuuagcacauaagacaaagcuaaccaagugggucauacucuacagucacuuauauauauauuuuuuuuaaggauccugaagguggaauguuuuaaaacauuaaaaccuucgaagaaaggcaaagacugacacaaaauagaauuaaggaacacgggugagaucccagagcugguuauagugugacagcaaagugaguucuuccagcagccugggcuugcugguagucaugaucuuccucggcacuggagagggcagauagaggaggcuucauagaggagaaaggacagauauggcaggcagcaaaugacucgcuuacuauguaaccccaugauucugugacaaaggcugcaauuccaauacacucaccgaguuuaaggucacugggcaaaaugggcaguggugacccagaacaguccuuugguauuaaaagccaagaguggcaugcacaguuaauggcaggcaagauucauuugcucccguucuggaaaugauugcaaguaaggaaugaccgacccauugaacuccuaaaagugaguucugugucagcuugggaugguaaguguacauucaaaaaaaaaaaaaaguauuagaaauauuuuaaacaccggguaauuucgaacuguucagggaaauccccugcuagaaaacauuccagcuggagugugcacgccuaccucccugccuacaagaaaaauacguguauuucacaacuaugacuuuacugcucuucagauuuucuucugaggcuucucuaguaggcuagguaggagcgggcugcucugauggcauuuugccagaucauuuaaaggugccugauugcuucccuaauaccuucugugacucacagagagauggcuaccccaucuaaagcaaucccgaaggcaauggucuggccccacucuuaaagaaaucccaagauagaaacuuuacgugaagauaucucaucucacagugccauccgcgucuuguuagugucugcauucauggaugaagaacaacauguaucuucuuucuggcacgucaacauuuugaggagucacucugauaagugacaccaguccauuggcugaacuuuuggaacaucuauaauguucugaauccaucacuguaacucucaguuaaccuuagggggguuaugaggcucccucuugauaauaugacacuauuaucaagguguucugcuuagaagccuuguuucuauugccugagaaagaagcacacacugcucuuuaaguugcaaagacauauucuguaucuugucuguauauaguagagauaugauuaaagaaggcacaugaauguccaauaagcuuggaaguaguacuucacccccccccccauuaaccaucaggaagauguaggccacagugugguacccaauucacaucuguaaaaugagugcuauggaaaaggcagauagcaucaaguguuggugagaagagggaguguccagagcgcucgcacauacuauugguugaagugcacacugguguagccauuuuggacaccugauucacagcaucugccaaagcuugaccuaugccuaccccaggagcacagcgacuugacucuuaagcacauacccaggggcgugagaacacaagaacaacaaacaauuauacaaacaaaaccauccugggauccucauacuuaagcaacaauuuucaauaagcauaaauaaaccacaaauuccauuagggcaaugguggacaggaaggaaggaacaacugagugcccuucuuggggcauuaauaaugucuguuuaaucuaggcucauauauaugggcauggacuuugugaacauuaaucaaguuauaccauuacuuuuuuuacaucuuccuguaugugcauuuuaacguuuauaugcagauauuacccuucaacacaagguuacaaaauuaauauggaucaggguuaccacuugcuagugagaguuccauucucucuuacuuugcuucuuacuggucugcuguguuuccuagguguuuuauggaggaaugggaaaaggauaguagcaaacucaggacaaauaaguuugguucuucucuaccucuuaacaaauagacucuauggaggugaccaaauuagaucacuagagucagaugucuggaaauuguaaaaaucuuagaggucaucucacaccacucaagagagcaaagcaaggcccagugaugucucgauaacuaaguacguacaccggcuuguugcagagaagggacaaccugugccuuccacaaggcagacccugggucaauuauuucuggagaaauuuuaaccuuuucauucuucugccuuagaugguaauuuguccuuaguucaaaaaugaaccucuucccuagaaaagauaaccugauaucuacucuggaauuagcaaauccgacuuccuaccccucccaaggagcagaauuccugaguguugaacacggagaggcuacauuuuguaagaaugagaagacauagagacuuggaagccugggaugagaucuccccgguuacuucuacuuuuaguacauuuaacacuucuaucuauuuuguauaccuuauguauguguguggguuugagugugccacagcaugcaugcagaggucagaggagcuagcucuuuccucccaccaugugugucccaggggauugagccuaagucaauggggcuugagagcaagcauccuuaccuacugagcuaacucaucagcaauaguccugguuuuagggaugagaaaacuaaggcacacgcagaacccuacuagcugguacugguuugauaaugagaaucagggucugcaacuguucauugugaguguuuggaaugagaugguuuaaggcucugugguggagggaguaacccuggaagacuuuuggaaauuggaauaggcagagggugggaaacacaaggaggaaagccaaaacccagcagaagacucaacacacacacacacacacacacacacacacacaaccacacacagacacacagacacaaacaaaggaugaacacuaagauauguccaugcaugugcguguacauguguguguaagcaugucauaacacccagggaaucuuugagacagucaucauucaauugaauugagauuagcuggguauugcuaacucguuuuauuuugucauuuaaacacgcuaaagaauaccauggcugugguuaggguuuuggcuggauuucagggcaauaugugaggaauaaaaaaguuguaacuaaaaaaaaaaaaaaaaaaaaaaaaaaaaaaacuuaacccuugagaauaugggaaccuucauuuacaccaacccacccccgaagccaccccucucgcuuagccaagcuguaucccauguguacauccccagcuaauucccaauugggcucucucaaauuuucuuccuuccgcccaugccacagcaugaucaucacgugucuccaaucccaacucugcugucagucugagacauuucuccauugcaacaugaaaugagagccuaggaugucauuuacugccuugucuacuugauuggauucugaauaucauuuacguggauauucucagccugguguuugacacagaaagacuauauggaaaggaaaucaggcucgagucccaagggcuuuuaaacuucuugccuccaagggugccaugcuucacccugccaguaccacacauccucuccuauuuuaagaggauuccuucuguaacuacuacaccaccaacagaauuucaaaacaaaaacaaagaaaaaccccuccccuuaauuccaucauguugaagguaggcuaacucuggcugcugaacacaauucuagauuaaaaugcaguuuuccccuuucaaagcaacagagaugcauguagccgguuagauuuguagaaugccuggucucccaagacguugcaaagcgaauggcauccaucaaauuaauuuccuuggggaucgucucaaacauggggaaugaaagggcccaggccauuaaacaucaaaagaauguucuaaaugcucauuaaaguucuauuauauuuucuuugcuuuucauuuuucuuucuuuuuucugcucccagagaccagauuagauuaauucaauuaaucuaauuuauaauuaucuguaauauuauacguaucagagcugacagugugaauguguggaguuggcuagagggagcuuaaugcgcuggacaucuguucauucaaguuauacaaaacacgaaagaacgaguuccauuagagcagggcagacucaccaagccggcacacguagacacagccacagaggacgagcugucauuucugauaaaucccugauacaaacacugcgguaccucaggcucccgagucucugaagcaccguccuuuccaaguacuuggacucuaaagugacugcucaagaucgccgagggcuuaagcucuaaauguagauccuguccaaaugcugaaacucgguagugcagggaguugcuggcaccgugugccgaucgccuuuuccuguggugcaaaaugucgugugaaauauaugacccgcccgaguccacuucuacuggcacgacaaagacguaaucuguaaugggaaaacaaaaaauuagcugucagcacccagagcccaagaugccaaaagggccacuuuccagcagcuugccccgaagcucacaaaaaaccuuguuccaugcaccuaacagugaagagaauucagagaggcuggcucacugcauucugagccaucgggcucugccagcuuaugcuauagcugggauuggggcucaggggcccagaacuugccuagcauuaaaaaauaaauaaacccuacaaaaaccaaaagcuaagugcaacuuugauaaaucucaaagauauuugggugaagggucaauucucagucugaaaggaaauacaggggcucuucauauauuagccauauguaaucauauguaacuuauuauuguugauaaaaaaaaucaguauaaaggauggauuugauugauagccuuguuuagguccaacuuagaaacuuuccugauggaguuuaaauugugaaugacucauaaaauaugcuguuucugauuauccccuuggcucauuaacaaggggcacccagcuacucacgccagcauuuggaucucccuuaguguuucaagaagccuccaccggggacucuccuguuuaaucccaggccuaaaauacaaccucggcaaaaaacaugccuccaaaccaucagaagcauccagauagaggcugauguuuggaacugcucagacuuguuggagggggcguggcagaucagggacaccuggaaaggcauguuuaaaaaugccuucccccuggcuccccugaacagcacuaauugcugugugaucuggggguguguacaggggcgggguggggggguuaggggaagcugggcagcgaggaaacaauuugcuauaggaaagagcaaagucaguaugcugcuuucuuucacaaaacauuggaauugaaaagcaucgucccagaagaugauguggagcaugcccagugugaauuaaaaaaaaaaaaaaaaaaaaaaaaaaaaaaaaacuuccacuuucuaggcacagaaugggaaacuaauuuguaaaguguuuagaaagauuccgaacaacuaagaggcauguuugagucacuuggguccuuggcuugcagaagagaaaggggggggagggggauucccuuccuugaacagucaacaacaaugaaauaaaaacagaagaugcuaaggaaucagggagucucggguguguagagaucgauacacaauacacaauucuaauugggcuuaauuaguaaagacacccaacaggaccauuugugacuuuuaagguguggccagcucuuuuaugguucuuucauuuucuccuucucuccuugaaacuagaaacacccuaucauugacauauucuucagaaaauaaaaggaaaaaauguguuucccuucucuuucccuuaaaacugagcagcacacaucuuaguucucaaaaauuucugauauguuguucugcagguauguagcuuuugauuaaagccgucuuucuuuccucgcuuuuuuuuuuaaaaagggaaaacccauuuucucuaucuaccagucauaccuaacuacauaauaaccuuuuccaacauaugugcgguuucuacaguguguguuuccgguuucuacaguguguguuucuuaccuccuugugcacggccaucugagauugcaccugcucuuacuuggaagaccauguaggcguguuagccaaucaucuagaccccucacccccuaccuaccccagacaccugcuacaaguuuguuuccaagagaggaacauacaggcuguugguuacauucaguccugucuuggagagggagcaccgagagguuggggggugggggugggggaaccaaugugcugugcucugcuagcuacuuaugguccuuucaggggcugggaaauauagcuuaguaagcagaguucuugucagacaugcaugaggcccuggguucaauccucaucacuacauaaaccagguguguugggcaugcaauaaggagguggacccuaaggccaaggucaucuuuuccaaagcuagauuacaugagacucugccuccaaaaacaaaauacagaaguacuuucgggccacgccugggacagaagagcuccccagccauuagauccugguggaacaggaaggaaguuuuagaaacuauagacucuggcugguccaguucauuucugggucuccuauucuccaaacauccaaucucuggaagcuuuuacacauaauucuaguggcuuucagucccagagucagcccuugcaccaggacaagaggacucaauucuacaaagaugaaaaauuuagaauccccagaaagccaugguggccuguaaggucuugcuaaagagcccugggcaaacaucaauuguccucuugcugcuagugggagacacugagaacaaggguuuuucucucucuaugaguucuguggaguuaauaaaugagaaaaccgaagcgugugcuagaucuuugaagcuggaagacagaaaaaaaaaggggggggacuuaaagcaccuugcgacaggguguucccccaaaagaagacaucuuuugggcauccgugaggcgaugucacugaagagagaguauucagugggaaaccagcaguaaggaaaacacggguggagugggggaggggagacacucaccccucucagccucaaucuguggcuuucccagcggaggaaggaaacgaaggagccuuuuaucaauuccccacccggugcccacuuccucucuaauuucuuacuuaaguucggauuuauuuuucuuaacaagccaucugugaaagagggaaauuauuuucucaucucugugacucguagcuugaggcacugauuuucugauaagcucacaggaccuugcugcgcuucccucuuucuaaccagggagccuuuugcucagacagcacacaccugccagguuaggagaugcuccuuaaccuaccacaucucacgcuaacacaaaggggaccaaagugcaaggggaaacccuugugggaugguggaguacccagagagaggguaaauacgaaccaucauuuaauccgcugccaccgcugcugccgcugucacuggcuaaggcgacggccaccgaagcacagcagaagcagcacagcuggagugccugcaagaaagaaaagggugacaccgccgcgugagcagcgucgcggggcgggcgccucccucguccccgcugugcggcgcgccccucggugguggcaccugccuuggccagacgccccagucccgcgggcccccacggcggcccgggaccugcggcccggagggcgcacaagcacaggagggcgcacuccauggucaggugcggacgcggugacuguggcaggcgcgcauugucccccgcgggcagcggagccccagguguggcgccaggugcgaguggccgccgccgcucacauggcagcacgagagccugcgagccuccucccugcucuagccucgcgggccugaggugcuucgggguguagggagcucugccagagcccggucugcagcgccuguggcuaugaaacucuguuggugaugcucgcgggucugggcgcuugucgguaucagagugauugugugcggcucgcacagagcagccagcuggcucccccagcgcgcuagagccgagcgcccgccucuccuccgcuccgugauuggcgaccggagguuu
